United States Patent
Moss et al.

(10) Patent No.: US 12,247,232 B2
(45) Date of Patent: Mar. 11, 2025

(54) METHODS AND COMPOSITIONS FOR INHIBITING ADAM 9 BIOLOGICAL ACTIVITIES

(71) Applicant: VERRA THERAPEUTICS, INC., Lansing, NY (US)

(72) Inventors: Marcia L. Moss, Apex, NC (US); Robert Rasmussen, Lansing, NY (US); Chris Prince, Ithaca, NY (US)

(73) Assignee: VERRA THERAPEUTICS, INC., Lansing, NY (US)

( * ) Notice: Subject to any disclaimer, the term of this patent is extended or adjusted under 35 U.S.C. 154(b) by 358 days.

(21) Appl. No.: 16/263,671

(22) Filed: Jan. 31, 2019

(65) Prior Publication Data
US 2019/0382745 A1 Dec. 19, 2019

Related U.S. Application Data

(60) Provisional application No. 62/624,491, filed on Jan. 31, 2018.

(51) Int. Cl.
| | | |
|---|---|---|
| *C12N 9/64* | (2006.01) | |
| *A61K 38/48* | (2006.01) | |
| *A61K 47/60* | (2017.01) | |
| *A61P 19/04* | (2006.01) | |
| *A61P 25/28* | (2006.01) | |
| *A61P 35/00* | (2006.01) | |
| *A61K 38/00* | (2006.01) | |
| *A61K 38/55* | (2006.01) | |

(52) U.S. Cl.
CPC ........ *C12N 9/6489* (2013.01); *A61K 38/4886* (2013.01); *A61K 47/60* (2017.08); *A61P 19/04* (2018.01); *A61P 25/28* (2018.01); *A61P 35/00* (2018.01); *A61K 38/00* (2013.01); *A61K 38/55* (2013.01); *C07K 2319/00* (2013.01)

(58) Field of Classification Search
CPC .... A61K 38/00; A61K 38/43; A61K 38/4886; A61K 38/54; A61K 38/55; A61K 47/60; A61P 19/04; A61P 25/28; A61P 35/00; C07K 2319/00; C12N 9/00; C12N 9/50; C12N 9/6489

See application file for complete search history.

(56) References Cited

U.S. PATENT DOCUMENTS

| 8,034,783 | B2 | 10/2011 | Moss et al. |
|---|---|---|---|
| 2004/0092466 | A1 | 5/2004 | Bennett et al. |
| 2009/0285640 | A1 | 11/2009 | Hilfiker et al. |
| 2009/0285840 | A1 | 11/2009 | Blobel et al. |
| 2009/0297507 | A1 | 12/2009 | Lai et al. |
| 2010/0111951 | A1 | 5/2010 | Mather et al. |
| 2012/0020991 | A1* | 1/2012 | Moss ........... C12N 9/6489 424/185.1 |
| 2012/0130044 | A1 | 5/2012 | Bachovchin et al. |
| 2013/0059788 | A1 | 3/2013 | Moss et al. |

FOREIGN PATENT DOCUMENTS

| WO | WO-2002/010405 A2 | 2/2002 |
|---|---|---|
| WO | WO 2004/024089 | 3/2004 |
| WO | WO-2011/100362 A1 | 8/2011 |
| WO | WO 2012/088105 | 6/2012 |
| WO | WO 2019/070685 | 4/2019 |

OTHER PUBLICATIONS

Gisela Weskamp, MDC9, a Widely Expressed Cellular Disintegrin Containing Cytoplasmic SH3 Ligand Domains , The Journal of Cell Biology, vol. 132, No. 4, Feb. 1996 717-726.*
Uniprot Protein Database, Protein Accession, Q13443 (ADAM9_Human), Disintegrin and metalloproteinase domain-containing protein 9, Uniprot entry Oct. 19, 2002.*
Banerjee et al. (2011) American Journal of Physiology—Gastrointestinal and Liver Physiology 300:G273-282.
Bech-Serra et al. (2006) Proteomic identification of desmoglein 2 and activated leukocyte cell adhesion molecule as substrates of ADAM17 and ADAM10 by difference gel electrophoresis. Molecular and Cellular Biology 26(13):5086-95.
Bergin et al. (2008) Journal of Biological Chemistry 283:31736-31744.
Dreymueller et al. (2015) ADAM-family metalloproteinases in lung inflammation: potential therapeutic targets. American Journal of Physiology Lung Cellular and Molecular Physiology 308(4):L325-43.
Fry et al. (2010) Secreted and membrane-bound isoforms of protease ADAM9 have opposing effects on breast cancer cell migration. Cancer Research 70(20):8187-8198.
Guaiquil et al. (2009) Molecular and Cellular Biology 29(10):2694-2703.
Hartmann et al. (2002) The disintegrin/metalloprotease ADAM 10 is essential for Notch signalling but not for α-secretase activity in fibroblasts. Human Molecular Genetics (11):2615-24.
International Search Report corresponding to International Patent Application No. PCT/US2018/053938 dated Feb. 5, 2019.
International Search Report corresponding to International Patent Application No. PCT/US2019/016015 dated Jun. 13, 2019.
Jefferson et al. (2013) The substrate degradome of meprin metalloproteases reveals an unexpected proteolytic link between meprin band ADAM10. Cellular and Molecular Life Sciences 70(2):309-333.

(Continued)

*Primary Examiner* — Julie Ha
*Assistant Examiner* — Erinne R Dabkowski
(74) *Attorney, Agent, or Firm* — MARSHALL, GERSTEIN & BORUN LLP

(57) ABSTRACT

Provided are ADAM9 modulating peptides and methods for using the same to modulate ADAM9 biological activities in vitro and/or in vivo, to inhibit ADAM9 biological activities associated with diseases or disorders in subjects, to decrease inflammation, and to inhibit undesirable cellular proliferation, fibrosis, and angiogenesis. In some embodiments, the ADAM9 modulating peptides include modifications of one or more amino acids of the human ADAM9 prodomain amino acid sequence, and in some embodiments the ADAM9 modulating peptides include other modifications such as but not limited to the addition of PEG groups.

21 Claims, 14 Drawing Sheets

Specification includes a Sequence Listing.

(56) References Cited

OTHER PUBLICATIONS

Lammich et al. (1999) Constitutive and regulated alpha-secretase cleavage of Alzheimer's amyloid precursor protein by a disintegrin metalloprotease. Proceedings of the National Academy of Sciences of the United States of America 96(7):3922-7.

Lemieux et al. (2007) The low affinity IgE receptor (CD23) is cleaved by the metalloproteinase ADAM10. The Journal of Biological Chemistry 282(20):14836-44.

Li et al. (2007) Metalloproteases regulate T-cell proliferation and effector function via LAG-3. The EMBO Journal 26(2):494-504.

Mathews et al. (2011) A potential new target for asthma therapy: a disintegrin and metalloprotease 10 (ADAM10) involvement in murine experimental asthma. Allergy 66(9):1193-200.

Mauch et al. (2010) Accelerated wound repair in ADAM-9 knockout animals. The Journal of Investigative Dermatology 130:2120-2130.

Moss et al. (2011) ADAM9 inhibition increases membrane activity of ADAM10 and controls α-secretase processing of amyloid precursor protein. Journal of Biological Chemistry 286(47):40443-40451.

Polverino et al. (2014) ADAM9 is upregulated in human COPD lungs and in human and murine lung in response to cigarette smoke European Respiratory Journal, 44(58):4856.

Roychaudhuri et al. (2014) ADAM9 Is a Novel Product of Polymorphonuclear Neutrophils: Regulation of Expression and Contributions to Extracellular Matrix Protein Degradation during Acute Lung Injury, Journal of Immunology 193:2469-2482.

Sahin et al. (2004) Distinct roles for ADAM10 and ADAM17 in ectodomain shedding of six EGFR ligands. The Journal of Cell Biology 164(5):769-79.

Schelter et al. (2010) A disintegrin and metalloproteinase-10 (ADAM-10) mediates DN30 antibody-induced shedding of the met surface receptor. The Journal of Biological Chemistry 285(34):26335-40.

Vazeille et al. (2011) Role of meprins to protect ileal mucosa of Crohn's disease patients from colonization by adherent-invasive *E. coli*, PLoS One 6:e21199.

Waldhauer et al. (2008) Tumor-Associated MICA is shed by ADAM proteases. Cancer Research (68):6368-76.

Witters et al. (2008) Synergistic inhibition with a dual epidermal growth factor receptor/HER-2/neu tyrosine kinase inhibitor and a disintegrin and metalloprotease inhibitor. Cancer Research 68(17):7083-9.

Wong et al. (2015) The Functional Maturation of a Disintegrin and Metalloproteinase (ADAM) 9, 10, and 17 Requires Processing at a Newly Identified Proprotein Convertase (PC) Cleavage Site. The Journal of Biological Chemistry 290(19):12135-46.

Wong et al. (2016) Harnessing the natural inhibitory domain to control TNFalpha Converting Enzyme (TACE) activity in vivo. Scientific Reports 6:35598.

Zhou et al. (2006) Targeting ADAM-mediated ligand cleavage to inhibit HER3 and EGFR pathways in non-small cell lung cancer. Cancer Cell 10(1):39-50.

Wang et al., A Disintegrin and A Metalloproteinase Domain-9 (ADAM9): A Novel Proteinase Culprit with Multifarious Contributions to COPD, *Am. J. Respir. Crit. Care Med.* 198(12):1500-1508 (2018).

Dreymueller et al., Considerations on inhibition approaches for proinflammatory functions of ADAM proteases, *Platelets (London)*. 28:354-61 (2017).

UniProt accession A0A0P6J568, submitted Jan. 20, 2016.
UniProt accession A0A2Y9DZI2, submitted Sep. 12, 2018.
UniProt accession A0A2Y9RNY3, submitted Sep. 12, 2018.

* cited by examiner

METHODS AND COMPOSITIONS FOR INHIBITING ADAM 9 BIOLOGICAL ACTIVITIES

CROSS REFERENCE TO RELATED APPLICATIONS

This application claims the benefit of U.S. Provisional Application Ser. No. 62/624,491, filed Jan. 31, 2018, the disclosure of which is incorporated herein by reference in its entirety.

TECHNICAL FIELD

The presently disclosed subject matter relates to compositions and methods pertaining to the inhibition of ADAM9. In particular, the presently disclosed subject matter relates to modified and purified prodomain of ADAM9, to mutations of prodomain polypeptides, and to modifications that stabilize prodomains for in vitro and vivo use. The presently disclosed subject matter further relates to the use of prodomains in cellular assays, and to the use of prodomains for treatment of diseases such as cancer, fibrosis, and chronic obstructive pulmonary disease.

BACKGROUND

ADAM9 is a member of the a disintegrin and metalloproteinase (ADAM) family (Edwards et al., 2008) that includes enzymes such as TACE (ADAM17), ADAM8, and ADAM10. In total, for humans, there are 33 ADAM family members. The ADAM proteins comprise a prodomain that is important for proper folding and transport of the enzyme through the cell, a catalytic domain containing a typical HEXXH motif, a disintegrin domain, that is used to interact with integrins, a cysteine rich region that is believed to be important for substrate recognition, a transmembrane domain, and a cytoplasmic tail that is involved in signaling events.

Members of the ADAM family are known to cleave type I and type II single membrane spanning proteins from cells to generate soluble mature proteins that have varying physiological roles (Edwards et al., 2008). For example, TACE is known to generate soluble epidermal growth factor (EGF) ligands such as TGF-alpha, amphiregulin, and HB-EGF (Sahin et al., 2004). Similarly, ADAM10 activity generates soluble proteins including, but not limited to, EGF ligands, EGF, HR-EGF, and betacellulin (Sahli) et al., 2004), Notch, amyloid precursor protein, ephrins, cadherins, protocadherins, chemokines such as CXCL16 and CX3C1, HER2, AXL, cMET, and CD23, a low affinity receptor for IgE (reviewed in Pruessmeyer & Ludwig, 2009). Excess ADAM9 activity may promote cell invasiveness and growth in tumor cell assays due to enhanced production of soluble epidermal growth factor (EGF) ligands and MT-MMP1.6 (Moss et al., 2011). In addition, ADAM9 activity is linked to neo-vascularization events through processing of Tic-2 and other factors and VEGFR2 (Guaiquil et al., 2009; Maretzky et al., 2017), and plays a protective role in wound healing (Mauch et al, 2010), acute lung injury (Royehaudhuri et al., 2014), and COPD (Wang et al., 2018) as ADAM9 knockout mice fare better than their wild type counterparts. In addition, inhibition of ADAM9 increases ADAM10 activity which promotes formation of soluble amyloid precursor protein-alpha which is linked to helping people with Alzheimer's disease (Moss et at, 2011). Inhibition of ADAM9 is also linked to increases in BMP7, and decreases in TGF-beta RI and activin RI (see Table 1) which is linked to fibrosis, and also decreases in MAC-1 and lymphotactin (see Table 1). These findings suggest that treating individuals with an ADAM9 inhibitor would be beneficial to certain fibrotic and pro-inflammatory conditions.

Accordingly, the ability to specifically modulate ADAM9 activity would be useful to study the biological functions of the protein, and for the treatment of disorders including but not limited to cancer, neovascular diseases, Alzheimer's, wound healing, acute lung injury, and chronic obstructive pulmonary disease (COPD).

Unfortunately, existing small molecule inhibitors are not specific for ADAM9 activity. For example, hydroxamates developed by GSK inhibit many ADAM members as well as other members of the matrix metalloproteinase family (Ludwig et al., 2005). Inhibitors disclosed by Incyte also inhibit MMPs, and possibly other ADAM family members (Zhou et al., 2006). Such non-specific inhibition often leads to unwanted side effects, and in this case has prevented the compounds from being developed into pharmaceutical drugs (Moss K. Sklair-Tavron, 2008).

ADAM family members are expressed as zymogens with the prodomains maintaining the enzymes in a latent state. For example, the prodomain of TACE suppresses the activity of its catalytic domain with a $K_i$ of 50 nM and inhibits TACE activity in vivo (Wong et al., 2016). The wild type prodomain of TACE, however, does not have good pharmacokinetic properties. Mutant prodomains that modified an upstream furin site and cysteine residue stabilized the TACE prodomain for in vivo use (Wong et al., 2016). Likewise, the wild type prodomain of ADAM10 does not have good pharmacokinetic properties, thereby making it difficult to be used as a drug. The reason for the poor pharmacokinetics could be due to processing by a furin convertase at the upstream cleavage site (amino acids 48-51 of human ADAM10). In addition, the sole cysteine at position 173 could interfere with the ability of the prodomain to have good pharmacokinetic properties as it can undergo oxidation to form a dimeric form of the prodomain. The ADAM9 prodomain has several meprin beta sites. ADAM10 has been shown to be a substrate for Meprin beta (Jefferson et al., 2013), and inhibition of meprin beta could have unwanted side effects (Bergin et al., 2008; Deuss et al. 2008; Banerjee et al., 2011; Vazeille et al., 2011; Schette et al., 2014).

Unlike ADAM10 and ADAM17, the prodomain of ADAM9 has 3 cysteines and an upstream furin site. These features of the prodomain make it unstable for in vitro and in vivo use.

Accordingly, there is a need in the art for selective inhibitors of ADAM9 to study the biological functions of the proteins and to treat diseases and disorders such as but not limited to cancer, neovascular diseases, wound healing, acute lung injury, and COPD.

SUMMARY

This summary lists several embodiments of the presently disclosed subject matter, and in many cases lists variations and permutations of these embodiments. This summary is merely exemplary of the numerous and varied embodiments. Mention of one or more representative features of a given embodiment is likewise exemplary. Such an embodiment can typically exist with or without the feature(s) mentioned; likewise, those features can be applied to other embodiments of the presently disclosed subject matter, whether listed in this summary or not. To avoid excessive repetition, this Summary does not list all possible combinations of such features.

In some embodiments, the presently disclosed subject matter relates to peptides comprising, consisting essentially of, or consisting of the amino acid sequence set forth in SEQ ID NO: 3, wherein relative to the amino acid sequence set forth in SEQ ID NO: 2, the peptide includes one or more amino acid substitutions and/or modifications (e.g., chemical modifications of the sulfhydryl groups of one or more of the cysteines present in SEQ ID NO: 2) at an amino acid position selected from the group consisting of amino acids 6, 7, 24, 26, 27, 61, 62, 85, 104, 137, 138, 146, 160, 161, 162, 163, and 164 such that the peptide is less inhibitory towards meprin, is less sensitive to furin cleavage, is less susceptible to oxidation and/or disulfide bond formation, or any combination thereof, as compared to a peptide without the one or more amino acid substitutions and/or modifications. In some embodiments, the peptide comprises, consists essentially of, or consists of an amino acid sequence that is at least 90% identical to SEQ ID NO: 2. In some embodiments, as compared to SEQ ID NO: 2, the amino acid sequence of the peptide comprises one or more amino acid substitutions and/or modifications selected from the group consisting of a substitution of arginine 24 to another amino acid, optionally alanine, serine, glycine, or lysine; a substitution of arginine 26 to another amino acid, optionally alanine, serine, glycine, or lysine; a substitution of arginine 27 to another amino acid, optionally alanine, serine, glycine, or lysine; a substitution of cysteine 85 to another amino acid, optionally serine, alanine, or glycine, a substitution of cysteine 104 to another amino acid, optionally serine, alanine, or glycine, a substitution of cysteine 146 to another amino acid, optionally serine, alanine, or glycine, and a chemical modification of one, two, or all three of cysteines 85, 104, and 146, or any combination thereof. In some embodiments, as compared to SEQ ID NO: 2, the amino acid sequence has a substitution at one or both of amino acids 6 and 7, wherein each substitution is independently any amino acid other than the amino acid present in SEQ ID NO: 2 at the corresponding position, optionally wherein each substitution is independently selected from the group consisting of alanine, serine, and glycine, and/or a substitution at one, two, or all three of amino acids 24, 26, and 27, wherein each substitution is independently any amino acid other than the amino acid present in SEQ ID NO: 2 at the corresponding position, optionally wherein each substitution is independently selected from the group consisting of alanine, serine, glycine, and lysine, and/or a substitution at one or both of amino acids 61 and 62, wherein each substitution is independently any amino acid other than the amino acid present in SEQ ID NO: 2 at the corresponding position, optionally wherein each substitution is independently selected from the group consisting of asparagine, alanine, serine, and glycine, and/or a substitution at one or both of amino acids 137 and 138, wherein each substitution is independently any amino acid other than the amino acid present in SEQ ID NO: 2 at the corresponding position, optionally wherein each substitution is independently selected from the group consisting of asparagine, alanine, serine, and glycine, and/or a substitution at one, two, three, four, or all five of amino acids 160-164, wherein each substitution is independently any amino acid other than the amino acid present in SEQ ID NO: 2 at the corresponding position, optionally wherein each substitution is independently selected from the group consisting of alanine, serine, glycine, and asparagine, and/or a substitution at one, two, or all three of amino acids 85, 104, and 146, wherein each substitution is independently any amino acid other than cysteine, optionally wherein each substitution is independently selected from the group consisting of serine, alanine, and glycine, or any combination or subcombination of the above. In some embodiments, as compared to SEQ ID NO: 2, the amino acid sequence has a serine at amino acid 85 and a serine at amino acid 104; an alanine at amino acid 26 and serines at amino acids 85, 104, and 146; an alanine at amino acid 24 and serines at amino acids 85, 104, and 146; an alanine at amino acid 27 and serines at amino acids 85, 104, and 146; serines at amino acids 85, 104, and 146; an alanine at amino acid 26; serines at amino acids 85, 104, and 146; and an alanine at amino acid 62; a glycine at amino acid 27 and serines at amino acids 85, 104, and 146; a serine at amino acid 27 and serines at amino acids 85, 104, and 146; an alanine at amino acid 27; serines at amino acids 85, 104, and 146 and a deletion of amino acids 1-6 of SEQ ID NO: 3; an alanine at amino acid 27 and serines at amino acids 85, 104, and 146; and a serine at amino acid 138; an alanine at amino acid 27, serines at amino acids 85, 104, and 146 and asparagines at amino acids 161 and 163; an alanine at amino acid 26, serines at amino acids 85, 104, and 146, and an addition of a GSGSC (SEQ ID NO: 27) pentapeptide C-terminal to amino acid 174 of SEQ ID NO: 3; an alanine at amino acid 27 and serines at amino acids 85 and 104; an alanine at amino acid 27, serines at amino acids 85, 104, and 146, and an addition of a GSCGS (SEQ ID NO: 26) pentapeptide N-terminal to amino acid 1 of SEQ ID NO: 3; and an alanine at amino acid 27, serines at amino acids 85, 104, and 146 and an addition of a GSGSC (SEQ ID NO: 27) pentapeptide C-terminal to amino acid 174 of SEQ ID NO: 3. In some embodiments, one, two, or all three of cysteines 85, 104, and 146 is/are: chemically modified at its a sulfhydryl group, optionally wherein the sulfhydryl group(s) is/are chemically modified by addition of a maleimide ester, an α-halocarbonyl, a thiosulfonate, or any combination thereof. In some embodiments, the amino acid sequence comprises, consists essentially of, or consists of a substitution of one or more of arginine 24, 26, and/or 27 to an amino acid other than arginine, a substitution of one or more of cysteines 85, 104, and 146 to an amino acid other than cysteine, optionally serine, or any combination thereof.

In some embodiments, the peptides of the presently disclosed subject matter further comprise a pegylated cysteine added to the N-terminus, to the C-terminus, or both, optionally wherein one or both of the pegylated cysteines comprise a PEG group having a molecular weight of about 1 kiloDalton (kDa) to about 40 kDa. In some embodiments, the amino acid sequence comprises, consists essentially of, or consists of a substitution of at least one of arginine 24, arginine 26, and arginine 27 to an amino acid other than arginine, and substitutions of cysteines 85, 104, and 146 to serine. In some embodiments, the amino acid at position 146 is cysteine and further wherein cysteine 146 is pegylated, optionally wherein cysteine 146 comprises a PEG group having a molecular weight of about 1 kDa to about 40 kDa. In some embodiments, one or more of cysteines 85, 104, and 146 comprises a chemical modification with a maleimide ester.

In some embodiments, the peptides of the presently disclosed subject matter further comprise modifications of arginine 24, arginine 26, and/or arginine 27 to increase resistance of the peptide to furin cleavage. In some embodiments, the modifications of arginine 24, arginine 26, and/or arginine 27 are independently selected at each amino acid from the group consisting of substitutions with any amino acid other than cysteine and chemical modifications, in some embodiments chemical modifications that modify the sulfhydryl group of the cysteine to a group that is less resistant to oxidation. In some embodiments, one or more of cysteines 85, 104, and 146 comprises a chemical modification resulting from reacting the one or more cysteines with a disulfide.

In some embodiments, the peptides of the presently disclosed subject matter comprise, consist essentially of, or consist of an amino acid sequence having a percent identity of at least 87% to any one of SEQ ID NOs: 3-23 and 28-430,947, optionally wherein the percent identity is at least 93%, and further optionally wherein the percent identity is at least 95%. In some embodiments, the peptide comprises, consists essentially of, or consists of an amino acid sequence having 100% percent identity to any one of SEQ ID NOs: 3-23 and 28-430,947 over its full length.

In some embodiments, the peptides of the presently disclosed subject matter further comprise one or more additional modifications selected from the group consisting of conservative amino acid substitutions, non-natural amino acid substitutions, D- or D,L-racemic mixture isomer form amino acid substitutions, amino acid chemical substitutions, carboxy- and/or amino-terminus modifications, glycosylations, and conjugations to biocompatible molecules such as but not limited to fatty acids and other peptides of interest.

In some embodiments, the peptides of the presently disclosed subject matter the peptide further comprise a modification of at least one of cysteines 85, 104, and/or 146, wherein the modification comprises attachment of a maleimide ester derivative comprising at least one moiety selected from the group consisting of a PEG group, a fluorescent moiety, an alkyl moiety, a colorimetric moiety, a bifunctional moiety, a radiometric moiety, a glycosyl moiety, a fatty acid moiety, a toxin, a therapeutic agent, optionally a chemotherapeutic agent, a linker, a peptide of interest, or any combination thereof.

In some embodiments, the presently disclosed subject matter also relates to compositions comprising the peptides disclosed herein. In some embodiments, the compositions are formulated for administration to a subject or are pharmaceutical compositions formulated for administration to a human.

In some embodiments, the presently disclosed subject matter also relates to fusion proteins that comprise a peptide as disclosed herein. In some embodiments, the fusion protein comprises the peptide conjugated to an agent selected from the group consisting of a therapeutic moeity, a diagnostic moiety, a detectable moiety, or any combination thereof, optionally wherein the peptide is conjugated to the agent via a linker molecule or via a peptide linkage. In some embodiments, the therapeutic molecule is selected from the group consisting of a therapeutic antibody, an Fc fragment, a receptor, a toxin, a chemotherapeutic molecule, or any combination thereof.

In some embodiments, the presently disclosed subject matter also relates to polypeptides comprising, consisting essentially of, or consisting of an amino acid sequence as set forth in any of SEQ ID NOs: 3-23 and 28-430,947. In some embodiments, the polypeptide does not comprise SEQ ID NO: 2, meaning that as compared to SEQ ID NO: 2, the amino acid sequence comprises at least one substitution, chemical modification, or any combination thereof.

In some embodiments, the polypeptides of the presently disclosed subject matter further comprise a tag, optionally a His tag, that can be employed for purification and/or isolation of the polypeptide from an expression system.

In some embodiments, the polypeptides of the presently disclosed subject matter further comprise a recognition site for a protease between the tag and an amino acid of the polypeptide that can be employed for releasing the tag from the polypeptide by proteolytic cleavage.

In some embodiments, the presently disclosed subject matter also relates to polypeptides comprising an amino acid sequence as set forth in any one of SEQ NOs: 3-23 and 28-430,947, and further comprise an addition of one or more amino acids to the N-terminus of the polypeptide, an addition of one or more amino acids to the C-terminus of the polypeptide, or an addition of one or more amino acids to both the N-terminus and the C-terminus of the polypeptide, wherein the one or more amino acids comprises at least one cysteine residue that provides functionality to conjugate a moiety of interest to the polypeptide. In some embodiments, the one or more amino acids added to the N-terminus of the polypeptide comprise, consist essentially of, or consists of SEQ ID NO: 26 and or the one or more amino acids added to the C-terminus of the polypeptide comprise, consist essentially of, or consists of SEQ ID NO: 27. In some embodiments, the polypeptide further comprises a PEG group conjugated to a cysteine present in the one or more amino acids added to the N-terminus and/or the C-terminus of the polypeptide, wherein the PEG group enhances the proper folding of the polypeptide and/or stabilizes the polypeptide to meprin cleavage relative to the polypeptide lacking a PEG group.

In some embodiments, the presently disclosed subject matter also relates to methods for modulating ADAM9 biological activities in vitro. In some embodiments, the methods comprise contacting a solution or a cell comprising an ADAM9 protein with a peptide or a composition as disclosed herein in an amount sufficient to inhibit the activity of the ADAM9 protein.

In some embodiments, the presently disclosed subject matter also relates to methods for inhibiting an ADAM9 biological activity in a subject. In some embodiments, the methods comprise administering to a subject a peptide or a composition as disclosed herein in an amount and via a route sufficient to contact an ADAM9 polypeptide present in the subject, whereby an ADAM9 biological activity in a subject is modulated.

In some embodiments, the presently disclosed subject matter also relates to methods for inhibiting ADAM9 biological activities in vivo. In some embodiments, the methods comprise administering to a subject a polypeptide comprising, consisting essentially of, or consisting of an amino acid sequence as set forth in any one of SEQ ID NOs: 3-23 and 28-430,947 in an amount and via a route sufficient to inhibit an ADAM9 biological activity in vivo, optionally wherein the polypeptide is pegylated.

In some embodiments, the presently disclosed subject matter also relates to methods for inhibiting ADAM9 biological activities associated with diseases or disorders in subjects. In some embodiments, the methods comprise contacting an ADAM9 protein present in a subject with an effective amount of a peptide or a composition as disclosed herein, wherein the disease or disorder is selected from the group consisting of cancer, inflammation, COPD, fibrosis, Alzheimer's disease, a wound, and undesirable angiogenesis, or wherein the subject has a predisposition thereto. In some embodiments, the disease or disorder comprises lung injury, optionally lung injury resulting from exposure to cigarette smoke, and the effective amount is sufficient to reduce elastin degradation, inflammation, a matrix metalloprotein biological activity, or any combination thereof in one or both of the subject's lungs. In some embodiments, the disease or disorder comprises a liver injury, optionally a liver injury associated with liver fibrosis, and the effective amount is sufficient to reduce a biological activity of an MMP9 gene product, an ADAMS gene product, or any combination thereof in the subject's liver. In some embodiments, the disease or disorder results at least in part from excess cell proliferation associated with an ADAM9 biological activity. In some embodiments, the subject has a disease or disorder characterized at least in part by undesirably high ADAM9 biological activity or ADAM9 protein expression. In some embodiments, the subject has a disease or disorder characterized at least in part by reduced ADAM10 activity.

In some embodiments, the presently disclosed subject matter also relates to methods for decreasing inflammation. In some embodiments, the methods comprise administering to a subject an effective amount of a peptide or a composition as disclosed herein.

In some embodiments, the presently disclosed subject matter also relates to methods for inhibiting cell invasion associated with undesirable ADAM9 biological activities in subjects. In some embodiments, the methods comprise administering to a subject in need thereof an effective amount of a peptide or a composition as disclosed herein.

In some embodiments, the presently disclosed subject matter also relates to methods for inhibiting the release of a substrate of ADAM9 in vivo. In some embodiments, the method comprises administering to a subject in need thereof a peptide comprising, consisting essentially of, or comprising an amino acid sequence as set forth in any one of SEQ ID NOs: 3-23 and 28-430,947, optionally wherein the peptide is pegylated.

In some embodiments of the presently disclosed methods, the peptide or the composition is formulated for administration via a route selected from the group consisting of inhalation, oral administration, intraadiposal administration, intraarterial administration, intraarticular administration, intracranial administration, intradermal administration, intralesional administration, intramuscular administration, intranasal administration, intraocular administration, intrapericardial administration, intraperitoneal administration, intrapleural administration, intraprostatic administration, intrarectal administration, intrathecal administration, intratracheal administration, intratumoral administration, intraumbilical administration, intravaginal administration, intravenous administration, intravesicular administration, intravitreal administration, subconjunctival administration, subcutaneous administration, sublingual administration, topical administration, transbuccal administration, oropharyngeal aspiration, and transdermal administration. In some embodiments, the peptide or the composition is delivered in a lipid composition, optionally a liposome or an ethosome; in a crème; via a catheter; via lavage; via infusion, optionally via continuous infusion; via inhalation; via injection; via local delivery; via localized perfusion; by bathing target cells directly; or any combination thereof.

In some embodiments, the presently disclosed subject matter also relates to methods for attaching a peptide consisting of, consisting essentially of, or comprising an amino acid sequence as set forth in any of SEQ ID NOs: 3-23 and 28-430,947 to an antibody, antibody fragment, or other protein, the method comprising conjugating the peptide to the antibody, antibody fragment, or other protein, optionally via a linker, further optionally via a peptide linker.

In some embodiments, the presently disclosed subject matter also relates to uses of an antibody, antibody fragment, polypeptide, protein, specific antibody, monoclonal antibody, peptide, inhibitory nucleic acid, and/or small molecule inhibitor of an ADAM9 biological activity to prevent development of and/or reduce the severity of at least one symptom of a disorder associated with undesirable ADAM9 biological activity in a subject in need thereof, optionally wherein the disorder associated with undesirable ADAM9 biological activity is selected from the group consisting of cancer, inflammation, COPD, fibrosis, Alzheimer's disease, and undesirable angiogenesis. In some embodiments, the subject is a human. In some embodiments, the disorder associated with undesirable ADAM9 biological activity is selected from the group consisting of COPD and fibrosis, optionally wherein the fibrosis is liver fibrosis.

In some embodiments, the presently disclosed subject matter also relates to peptides comprising, consisting essentially of, or consisting of any of SEQ ID NOs: 3-23 and 28-430,947, wherein at least one meprin cleavage site present therein is modified to render the peptide less inhibitory towards meprin, optionally wherein the at least one meprin cleavage site is selected from the group consisting of amino acids 5-7 of SEQ ID NO: 3, amino acids 60-62 of SEQ ID NO: 3, amino acids 136-138 of SEQ ID NO: 3, and amino acids 159-164 of SEQ ID NO: 3, and further wherein the at least one meprin cleavage site is selected from the group consisting of amino acids 5-7 of SEQ ID NO: 3, amino acids 60-62 of SEQ ID NO: 3, amino acids 136-138 of SEQ ID NO: 3, and amino acids 159-164 of SEQ ID NO: 3, and further wherein the at least one meprin cleavage site present therein is modified to comprise an amino acid sequence selected from the group consisting of FXX, PXX, MXX, FXQ, FQX, PXD, PEX, MXD, MDX, KXEXEX, KDXEXE, KDXXXE, KXEXXE, KXXEXE, KXXXXX, KXEXXX, KXXEXX, KXXXEX, KXXXXE, KXXXXX or any combination thereof, where each X is independently any amino acid sequence, and further optionally wherein each X is independently selected from the group consisting of asparagine, glycine, alanine, and serine.

In some embodiments, the presently disclosed subject matter also relates to polypeptides comprising, consisting essentially of, or consisting of an amino acid sequence as set forth in any one of SEQ ID NOs: 3-23 and 28-430,947, wherein one or more cysteines that correspond to amino acid residues of SEQ ID NO: 3 selected from the group consisting of cysteines 85, 104, and 146, or any combination thereof, is/are conjugated to one or more moieties that improve the inhibitory potency, solubility, and/or a pharmacokinetic property of the polypeptide relative to the polypeptide lacking the moiety, and/or is conjugated to one or more chromophores, fluorophores, and/or radionucleotides.

In some embodiments, the presently disclosed subject matter also relates to polypeptides comprising, consisting essentially of, or consisting of an amino acid sequence as set forth in one of SEQ ID NOs: 3-23 and 28-430,947, for use in treating a subject with a disorder associated with undesirable ADAM9 biological activity, optionally wherein the disorder associated with undesirable ADAM9 biological activity is selected from the group consisting of cancer, inflammation, COPD, fibrosis, Alzheimer's disease, a wound, and undesirable angiogenesis, optionally wherein the polypeptide is pegylated at one or more of the amino acids of SEQ ID NOs: 3-23 and 28-430,947. In some embodiments, the polypeptide is pegylated. In some embodiments, the subject is a human.

In some embodiments, the presently disclosed subject matter also relates to uses of inhibitors of ADAM9 biological activities to treat subjects with disorders associated with undesirable ADAM9 biological activities. In some embodiments, the inhibitor of the ADAM9 biological activity is selected from the group consisting of an antibody or a fragment thereof, optionally wherein the antibody is a monoclonal antibody, a protein, a peptide, an inhibitory nucleic acid, and/or a small molecule, optionally wherein the disorder associated with undesirable ADAM9 biological activity is selected from the group consisting of cancer, inflammation, COPD, fibrosis, Alzheimer's disease, a wound, and undesirable angiogenesis. In some embodiments, the subject is a human.

In some embodiments, the presently disclosed subject matter also relates to polypeptides comprising, consisting essentially of, or consisting of an amino acid sequence as set forth in one of SEQ ID NOs: 3-23 and 28-430,947, for use in preventing development of and/or reducing the severity of at least one symptom of a disorder associated with an undesirable ADAM9 biological activity. In some embodiments, the disorder associated with undesirable ADAM9 biological activity is selected from the group consisting of cancer, inflammation, COPD, fibrosis, Alzheimer's disease, a wound, and undesirable angiogenesis, in a subject in need thereof, optionally wherein the subject has a predisposition to development the at least one symptom. In some embodiments, the polypeptide is pegylated. In some embodiments, the subject is a human. In some embodiments, the disorder associated with undesirable ADAM9 biological activity is selected from the group consisting of COPD and fibrosis, optionally wherein the fibrosis is liver fibrosis.

In some embodiments, the presently disclosed subject matter also relates to peptides comprising, consisting essentially of, or consisting of any of SEQ ID NOs: 3-23 and 28-430,947, wherein at least one furin or furin-like cleavage site present therein is modified to render the at least one furin or furin-like cleavage site more resistant to cleavage by a Turin or furin-like convertase as compared to the at least one furin or furin-like cleavage site that is unmodified. In some embodiments, the at least one furin or furin-like cleavage site consists of the tetrapeptide sequence RXRR, RXKR, RXXR, or RXRK, where X is any amino acid.

In some embodiments, the presently disclosed subject matter also relates to polypeptides comprising, consisting essentially of, or consisting of an amino acid sequence as set forth in any one of SEQ ID NOs: 3-23 and 28-430,947, wherein the amino acid sequence comprises a substitution of one or more charged amino acids relative to SEQ ID NO: 2 such that the solubility of the polypeptide is increased in a pre-determined solvent relative to a polypeptide comprising, consisting essentially of, or consisting of an amino acid sequence as set forth in SEQ ID NO: 2, and further wherein the pre-determined solvent is selected from the group consisting of a biological fluid and a cell culture medium.

In some embodiments, the presently disclosed subject matter also relates to polypeptides comprising an amino acid sequence as set forth in any one of SEQ ID NOs: 3-23 and 28-430,947 and further comprising a C-terminal spacer containing one or more charged residues, optionally selected from the group consisting of Asp, Glu, Arg, and Lys, wherein solubility of the polypeptide with the C-terminal spacer with respect to a pre-determined solvent is greater than that of the same polypeptide absent the C-terminal spacer.

In some embodiments, the presently disclosed subject matter also relates to polypeptides comprising an amino acid sequence as set forth in any one of SEQ ID NOs: 3-23 and 28-430,947 and further comprising an N-terminal spacer containing one or more charged residues, optionally selected from the group consisting of Asp, Glu, Arg, and Lys, wherein solubility of the polypeptide with the N-terminal spacer with respect to a pre-determined solvent is greater than that of the same polypeptide absent the N-terminal spacer.

In some embodiments, the presently disclosed peptides, polypeptides, and/or fusions proteins of the presently disclosed subject matter are modified by amino acid substitutions, chemical modifications, or combinations thereof such that the peptides, polypeptides, and/or fusions proteins are less susceptible to cleavage by meprin as compared to the peptides, polypeptides, and/or fusions proteins that lack the modification(s). In some embodiments, the modifications are modifications of one or more of cysteines 85, 104, and/or 146 of SEQ ID NO: 3 or at a position in the peptides, polypeptides, and/or fusions proteins that corresponds to one or more of cysteines 85, 104, and/or 146 of SEQ ID NO: 3.

In some embodiments, the presently disclosed peptides, polypeptides, and/or fusions proteins of the presently disclosed subject matter are present in a composition, optionally a pharmaceutical composition, wherein the composition is formulated for administration to a subject or is a pharmaceutical composition formulated for administration to a human.

An object of the presently disclosed subject matter having been stated above, other objects and advantages will become apparent upon a review of the following Detailed Description and is EXAMPLES, particularly in view of the Figures.

BRIEF DESCRIPTION OF THE FIGURES

In FIG. 9B, the percent inhibition of VEGFR2 signaling relative to vehicle control (set at 100%) for 30 nM and 300 nM furin mutant SEQ ID NO: 12, 30 nM and 300 nM SEQ ID NO: 13 (no furin mutations), and 100 nM C-terminal pegylated SEQ ID NO: 20 is shown. Error bars are +standard error of the mean (S.E.M.). SEQ ID NO: 12 reduced most of the protein levels with better potency than SEQ ID NO: 13. Pegylated SEQ ID NO: 20, which also had the best IC50 using in vitro enzymatic assays, appeared to be the most potent inhibitor.

REFERENCE TO SEQUENCE LISTING SUBMITTED ON COMPACT DISCS

Figure 1:
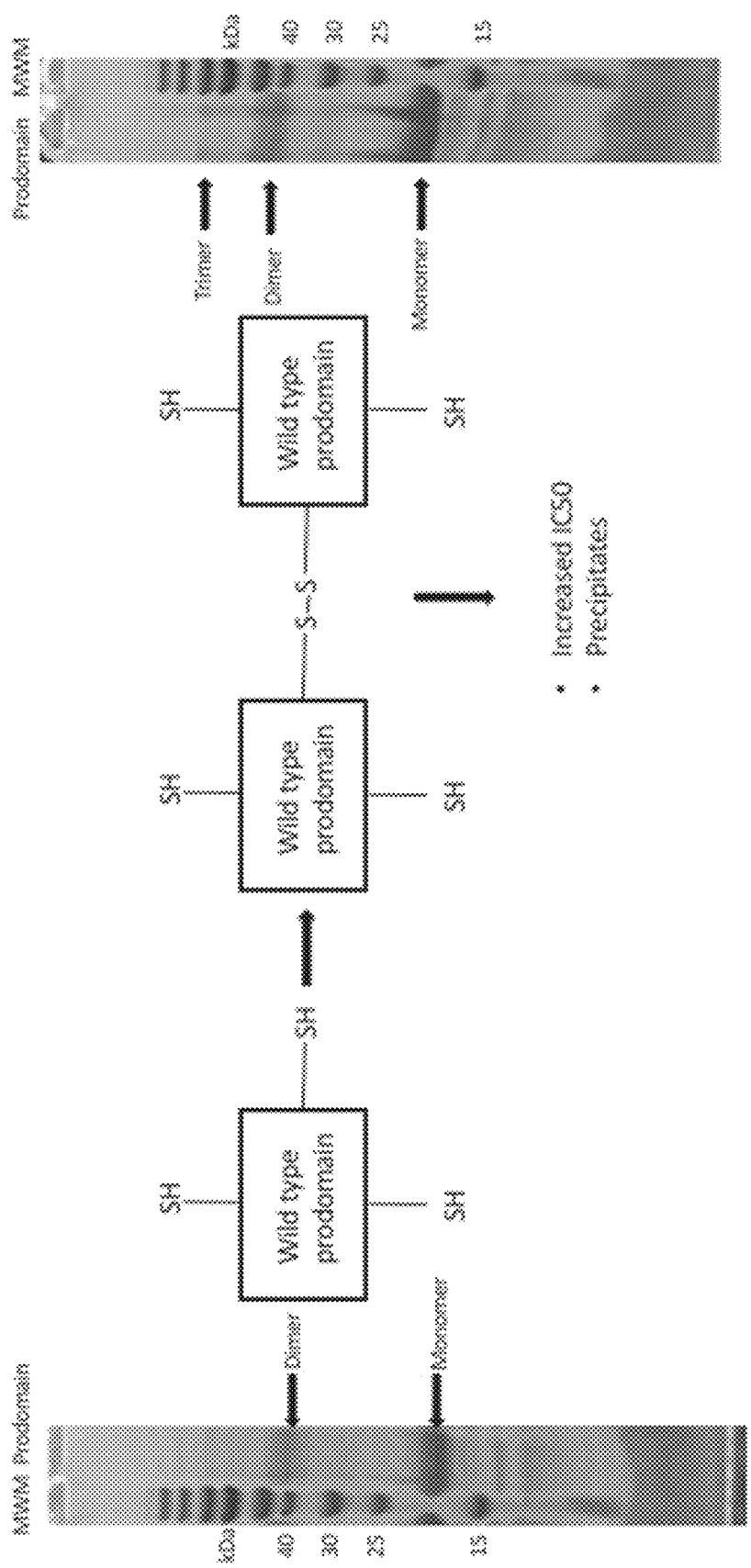
FIG. 1 depicts a stained gel showing the effects of storage of wild type ADAM9 prodomain peptides (SEQ ID NO: 2) at −20° C., particularly with respect to dimer and trimer formation. Upon storage, SEQ ID NO: 2 precipitated after 2 weeks. The gel shows freshly prepared SEQ ID NO: 2 (left panel) and urea-solubilized precipitate after two weeks storage at −20° C. (right panel).

The Sequence Listing associated with the instant disclosure has been submitted as a 671 MB files in triplicate on three (3) compact discs (CRF Copy, Copy 1, and Copy 2, with the contents of each compact disc being identical. The compact discs are marked in indelible ink to identify the Applicant, Title, File Name (FINAL_3217_4_2_ST25.txt), Creation Date (Jan. 31, 2019), Computer System (ASCII DOS Format), and the Serial No. of the corresponding U.S. utility application. The Sequence Listing submitted on the compact discs is hereby incorporated by reference in its entirety into the instant disclosure.

BRIEF DESCRIPTION OF THE SEQUENCE LISTING

SEQ ID NO: 1 is the amino acid sequence of an exemplary human ADAM9 gene product as set forth in Accession No. NP_903807.1 of the GENBANK® biosequence database.

SEQ ID NO: 2 is the amino acid sequence of an exemplary human ADAM9 prodomain peptide. It corresponds to amino acids 30-203 of SEQ ID NO: 1.

SEQ ID NO: 3 is a consensus core amino acid sequence of the modified ADAM9 prodomain peptides of the presently disclosed subject matter. It is based on SEQ ID NO: 2 and differs from SEQ ID NO: 2 by virtue of the positions at which the modified ADAM9 prodomain peptides of the presently disclosed subject matter differ from SEQ ID NO: 2 within its core denoted by "X", wherein X is any amino acid or a modification thereof.

SEQ ID NO: 4 is SEQ ID NO: 3 with an N-terminal cysteine added.

SEQ ID NO: 5 is SEQ ID NO: 3 with a C-terminal cysteine added.

SEQ ID NO: 6 is a modified ADAM9 prodomain peptide, wherein the wild type human ADAM9 prodomain peptide of SEQ ID NO: 2 has been substituted in the furin recognition site at amino acids 24, 26, and 27.

SEQ ID NO: 7 is a modified ADAM9 prodomain peptide, wherein the wild type human ADAM9 prodomain peptide of SEQ ID NO: 2 has been substituted in the furin recognition site at amino acids 24, 26, and 27 and with serines at cysteines 85 and 104.

SEQ ID NO: 8 is a modified ADAM9 prodomain peptide, wherein the wild type human ADAM9 prodomain peptide of SEQ ID NO: 2 has been substituted with serines at cysteines 85 and 104.

SEQ ID NO: 9 is a modified ADAM9 prodomain peptide, wherein the wild type human ADAM9 prodomain peptide of SEQ ID NO: 2 has been substituted in the furin recognition site at amino acid 26 with an alanine and also with a serine substitution at cysteine 146.

SEQ ID NO: 10 (also referred to herein as "Seq 11") is a modified ADAM9 prodomain peptide, wherein the wild type human ADAM9 prodomain peptide of SEQ ID NO: 2 has been substituted in the furin recognition site at amino acid 26 with an alanine and also with serine substitutions at cysteines 85, 104, and 146.

SEQ ID NO: 11 (also referred to herein as "Seq 17B") is a modified ADAM9 prodomain peptide, wherein the wild type human ADAM9 prodomain peptide of SEQ ID NO: 2 has been substituted in the furin recognition site at amino acid 24 with an alanine and with serine substitutions at cysteines 85, 104, and 146.

SEQ ID NO: 12 (also referred to herein as "Seq 25") is a modified ADAM9 prodomain peptide, wherein the wild type human ADAM9 prodomain peptide of SEQ ID NO: 2 has been substituted in the furin recognition site at amino acid 27 with an alanine and with serine substitutions at cysteines 85, 104, and 146.

SEQ ID NO: 13 (also referred to herein as "Seq 26") is a modified. ADAM9 prodomain peptide, wherein the wild type human ADAM9 prodomain peptide of SEQ ID NO: 2 has been substituted with serine substitutions at cysteines 85, 104, and 146.

SEQ ID NO: 14 (also referred to herein as "Seq 27") is a modified ADAM9 prodomain peptide, wherein the wild type human ADAM9 prodomain peptide of SEQ ID NO: 2 has been substituted in the furin recognition site at amino acid 26 with an alanine, in the second meprin recognition site at amino acid 62 with an alanine, and with serine substitutions at cysteines 85, 104, and 146.

SEQ ID NO: 15 (also referred to herein as "Seq 28") is a modified ADAM9 prodomain peptide, wherein the wild type human ADAM9 prodomain peptide of SEQ ID NO: 2 has been substituted in the furin recognition site at amino acid 27 with a glycine and also with serine substitutions at cysteines 85, 104, and 146.

SEQ ID NO: 16 (also referred to herein as "Seq 29") is a modified ADAM9 prodomain peptide, wherein the wild type human ADAM9 prodomain peptide of SEQ ID NO: 2 has been substituted in the furin recognition site at amino acid 27 with a serine and also with serine substitutions at cysteines 85, 104, and 146.

SEQ ID NO: 17 (also referred to herein as "Seq 30") is a modified ADAM9 prodomain peptide, wherein amino acids 1-6 of the wild type human ADAM9 prodomain peptide of SEQ ID NO: 2 have been deleted, the furin recognition site has been substituted at amino acid 27 with an alanine, and cysteines 85, 104, and 146 have been substituted with serines.

SEQ ID NO: 18 (also referred to herein as "Seq 31") is a modified. ADAM9 prodomain peptide, wherein the wild type human ADAM9 prodomain peptide of SEQ ID NO: 2 has been substituted in the furin recognition site at amino acid 27 with an alanine, in the third meprin recognition site at amino acid 138 with a serine, and at cysteines 85, 104, and 146 with serines.

SEQ ID NO: 19 (also referred to herein as "Seq 32") is a modified ADAM9 prodomain peptide, wherein the wild type human ADAM9 prodomain peptide of SEQ ID NO: 2 has been substituted in the furin recognition site at amino acid 27 with an alanine, in the fourth meprin recognition site at amino acids 161 and 163 with asparagines, and at cysteines 85, 104, and 146 with serines.

SEQ ID NO: 20 (also referred to herein as "Seq 1102") is a modified ADAM9 prodomain peptide, wherein the wild type human ADAM9 prodomain peptide of SEQ ID NO: 2 has been substituted in the furin recognition site at amino acid 26 with an alanine, at cysteines 85, 104, and 146 with serines; and has a pentapeptide added to its C-terminus.

SEQ ID NO: 21 (also referred to herein as "Seq 25-1") is a modified ADAM9 prodomain peptide, wherein the wild type human ADAM9 prodomain peptide of SEQ ID NO: 2 has been substituted in the furin recognition site at amino acid 27 with an alanine, at cysteines 85 and 104 with serines.

SEQ ID NO: 22 (also referred to herein as "Seq 25-2") is a modified ADAM9 prodomain peptide, wherein the wild type human ADAM9 prodomain peptide of SEQ ID NO: 2 has been substituted in the furin recognition site at amino acid 27 with an alanine, at cysteines 85, 104, and 146 with serines; and has a pentapeptide added to its N-terminus.

SEQ ID NO: 23 (also referred to herein as "Seq 25-3") is a modified ADAM9 prodomain peptide, wherein the wild type human ADAM9 prodomain peptide of SEQ ID NO: 2 has been substituted in the furin recognition site at amino acid 27 with an alanine, at cysteines 85, 104, and 146 with serines; and has a pentapeptide added to its C-terminus.

SEQ ID NO: 24 is the sequence of a His tag peptide consisting of six (6) His amino acids.

SEQ ID NO: 25 is an exemplary meprin recognition sequence that corresponds to the fourth meprin recognition sequence of the ADAM9 prodomain peptide of SEQ ID NO: 2.

SEQ ID NO: 26 is an exemplary pentapeptide sequence that can be attached to the N-terminus of a modified ADAM9 prodomain peptide of the presently disclosed subject matter to provide functionality for conjugating a PEG group.

SEQ ID NO: 27 is an exemplary pentapeptide sequence that can be attached to the C-terminus of a modified. ADAM9 prodomain peptide of the presently disclosed subject matter to provide functionality for conjugating a PEG group.

SEQ ID NOs: 28-430,947 are the amino acid sequences of exemplary ADAM9 prodomain peptides of the presently disclosed subject matter.

DETAILED DESCRIPTION

The presently disclosed subject matter relates in some embodiments to modified ADAM9 modulating peptides and related compositions useful for studying the biological functions of ADAM9 and/or for the treatment of diseases and disorders associated with undesirable ADAM9 biological activities such as but not limited to cancer, inflammation, COPD (characterized by any or all phenotypes such as small airway fibrosis, mucus metaplasia and emphysema), fibrosis, Alzheimer's disease, a wound, and undesirable angiogenesis and disorders characterized at least in part by the presence of one or more of inflammation, excess cell proliferation, angiogenesis, fibrosis, and excess or decreased soluble proteins described in Table 1.

TABLE 1

Exemplary Proteins Impacted by ADAM9 Modulating Peptides

Factors Downregulated

Activin RIA/ALK-2; CCL14/HCC-1/HCC-3; Dkk-1; GITR Ligand/ TNFSF18; TGF-α; TNF-β; LBP; Lymphotactin/XCL1; MAC-1; MMP-16/MT3-MMP; MAC-1; Neuropilin-2; OX40 Ligand/TNFSF4; PD-ECGF; PDGFRA; ROBO4; S100 A8/A9; SAA; Siglec-5/CD170; Spinesin; Tarc; TCCR/WSX-1; TECK/CCL25; TGF-beta RI/ALK-5; TNF-β; TWEAK/TNFSF12

Factors Upregulated

MMP-2; BMPR-IA/ALK-3; IFN-γ; BMPR-I; IL-1 α; IL-1Ra; IL-1 sRI; Fractalkine; BMPR-2; BMP-5; BMP-7; BMP-15; CD30/TNFRSF8; CD40/TNFRSF5; CD40 Ligand/TNFSF5/CD154; IL-1 sRII; IL-3; IL-5; IL-7; IL-10 Rβ; IL-15; IL-15 Rα; IL-16; Lymphotoxin beta RTNFRSF3; sAPPα

Accordingly, in some embodiments the presently disclosed subject matter provides specific inhibitors of ADAM9 activity and methods for using the same to study the biological functions of ADAM9 and/or for the treatment of diseases and disorders associated with undesirable ADAM9 biological activities.

The presently disclosed subject matter now will be described more fully hereinafter, in which some, but not all embodiments of the presently disclosed subject matter are described. Indeed, the presently disclosed subject matter can be embodied in many different forms and should not be construed as limited to the embodiments set forth herein; rather, these embodiments are provided so that this disclosure will satisfy applicable legal requirements.

I. Definitions

The terminology used herein is for the purpose of describing particular embodiments only and is not intended to be limiting of the presently disclosed subject matter.

While the following terms are believed to be well understood by one of ordinary skill in the art, the following definitions are set forth to facilitate explanation of the presently disclosed subject matter.

All technical and scientific terms used herein, unless otherwise defined below, are intended to have the same meaning as commonly understood by one of ordinary skill in the art. References to techniques employed herein are intended to refer to the techniques as commonly understood in the art, including variations on those techniques or substitutions of equivalent techniques that would be apparent to one of skill in the art. While the following terms are believed to be well understood by one of ordinary skill in the art, the following definitions are set forth to facilitate explanation of the presently disclosed subject matter.

In describing the presently disclosed subject matter, it will be understood that a number of techniques and steps are disclosed. Each of these has individual benefit and each can also be used in conjunction with one or more, or in some cases all, of the other disclosed techniques.

Accordingly, for the sake of clarity, this description will refrain from repeating every possible combination of the individual steps in an unnecessary fashion. Nevertheless, the specification and claims should be read with the understanding that such combinations are entirely within the scope of the invention and the claims.

Following long-standing patent law convention, the terms "a", "an", and "the" refer to "one or more" when used in this application, including the claims. For example, the phrase "an antibody" refers to one or more antibodies, including a plurality of the same antibody. Similarly, the phrase "at least one", when employed herein to refer to an entity, refers to, for example, 1, 2, 3, 4, 5, 6, 7, 8, 9, 10, 15, 20, 25, 30, 35, 40, 45, 50, 75, 100, or more of that entity, including but not limited to whole number values between 1 and 100 and greater than 100.

Unless otherwise indicated, all numbers expressing quantities of ingredients, reaction conditions, and so forth used in the specification and claims are to be understood as being modified in all instances by the term "about". The term "about", as used herein when referring to a measurable value such as an amount of mass, weight, time, volume, concentration or percentage is meant to encompass variations of in some embodiments ±20%, in some embodiments ±10%, in some embodiments ±5%, in some embodiments ±1%, in some embodiments ±0.5%, and in some embodiments ±0.1% from the specified amount, as such variations are appropriate to perform the disclosed methods. Accordingly, unless indicated to the contrary, the numerical parameters set forth in this specification and attached claims are approximations that can vary depending upon the desired properties sought to be obtained by the presently disclosed subject matter.

As used herein, the term "and/or" when used in the context of a list of entities, refers to the entities being present singly or in combination. Thus, for example, the phrase "A, B, C, and/or D" includes A, B, C, and D individually, but also includes any and all combinations and subcombinations of A, B, C, and D.

The term "comprising", which is synonymous with "including" "containing", or "characterized by", is inclusive or open-ended and does not exclude additional, unrecited elements and/or method steps. "Comprising" is a term of art that means that the named elements and/or steps are present, but that other elements and/or steps can be added and still fall within the scope of the relevant subject matter.

As used herein, the phrase "consisting of" excludes any element, step, or ingredient not specifically recited. It is noted that, when the phrase "consists of" appears in a clause of the body of a claim, rather than immediately following the preamble, it limits only the element set forth in that clause; other elements are not excluded from the claim as a whole.

As used herein, the phrase "consisting essentially of" limits the scope of the related disclosure or claim to the specified materials and/or steps, plus those that do not materially affect the basic and novel characteristic(s) of the disclosed and/or claimed subject matter. For example, a pharmaceutical composition can "consist essentially of" a pharmaceutically active agent or a plurality of pharmaceutically active agents, which means that the recited pharmaceutically active agent(s) is/are the only pharmaceutically active agent(s) present in the pharmaceutical composition. It is noted, however, that carriers, excipients, and other inactive agents can and likely would be present in the pharmaceutical composition.

With respect to the terms "comprising", "consisting of", and "consisting essentially of", where one of these three terms is used herein, the presently disclosed and claimed subject matter can include the use of either of the other two terms. For example, in some embodiments, the presently disclosed subject matter relates to compositions comprising antibodies. It would be understood by one of ordinary skill in the art after review of the instant disclosure that the presently disclosed subject matter thus encompasses compositions that consist essentially of the antibodies of the presently disclosed subject matter, as well as compositions that consist of the antibodies of the presently disclosed subject matter.

As used herein, the phrase "chronic obstructive pulmonary disease (COPD)" refers to chronic obstructive pulmonary disease and its key COPD-like phenotypes including but not limited to: emphysema, small airway fibrosis, and mucus cell metaplasia (as it occurs in the large airways of COPD patients and contributes to the chronic bronchitis phenotype).

The term "subject" as used herein refers to a member of any invertebrate or vertebrate species. Accordingly, the term "subject" is intended to encompass any member of the Kingdom Animalia including, but not limited to the phylum Chordata (e.g., members of Classes Osteichythyes (bony fish), Amphibia (amphibians), Reptilia (reptiles), Aves (birds), and Mammalia (mammals)), and all Orders and Families encompassed therein.

The compositions and methods of the presently disclosed subject matter are particularly useful for warm-blooded vertebrates. Thus, the presently disclosed subject matter concerns mammals and birds. More particularly provided are compositions and methods derived from and/or for use in mammals such as humans and other primates, as well as those mammals of importance due to being endangered (such as Siberian tigers), of economic importance (animals raised on farms for consumption by humans) and/or social importance (animals kept as pets or in zoos) to humans, for instance, carnivores other than humans (such as cats and dogs), swine (pigs, hogs, and wild boars), ruminants (such as cattle, oxen, sheep, giraffes, deer, goats, bison, and camels), rodents (such as mice, rats, and rabbits), marsupials, and horses. Also provided is the use of the disclosed methods and compositions on birds, including those kinds of birds that are endangered, kept in zoos, as well as fowl, and more particularly domesticated fowl, e.g., poultry, such as turkeys, chickens, ducks, geese, guinea fowl, and the like, as they are also of economic importance to humans. Thus, also provided is the use of the disclosed methods and compositions on livestock, including but not limited to domesticated swine (pigs and hogs), ruminants, horses, poultry, and the like.

Similarly, all genes, gene names, and gene products disclosed herein are intended to correspond to homologs from any species for which the compositions and methods disclosed herein are applicable. Thus, the terms include, but are not limited to genes and gene products from humans and mice. It is understood that when a gene or gene product from a particular species is disclosed, this disclosure is intended to be exemplary only, and is not to be interpreted as a limitation unless the context in which it appears clearly indicates. Thus, for example, for the genes presented herein, the human amino acid sequences disclosed are intended to encompass homologous genes and gene products from other animals including, but not limited to other mammals, fish, amphibians, reptiles, and birds. Also encompassed are any and all nucleotide sequences that encode the disclosed amino acid sequences, including but not limited to those disclosed in the corresponding GENBANK® entries.

Table 2 provides the GENBANK® biosequence database accession numbers for exemplary ADAM9 nucleic acids and polypeptides of the presently disclosed subject matter. It is noted that the entries in Table 2 are intended to be exemplary only.

TABLE 2

Nucleotide and Amino Acid Sequences of Exemplary ADAM9 Orthologs

| Species | Nucleotide | Amino Acid |
|---|---|---|
| Homo sapiens | NM_003816.2 | NP_003807.1 |
| | XM_011544682.2 | XP_011542984.1 |
| | XM_017013942.1 | XP_016869431.1 |
| Pan troglodytes | XM_001135576.3 | XP_001135576.1 |
| Gorilla gorilla gorilla | XM_004046912.2 | XP_004046960.1 |
| Pongo abelii | XM_003777238.2 | XP_003777286.1 |
| | XM_009243738.1 | XP_009242013.1 |
| Macaca mulatta | XM_001092710.3 | XP_001092710.1 |
| Mus musculus | NM_001270996.1 | NP_001257925.1 |
| | NM_007404.2 | NP_031430.2 |
| Canis lupus familiaris | NM_001195402.1 | NP_001182331.1 |
| Felis catus | XM_003984768.5 | XP_003984817.1 |
| Equus caballus | XM_001491500.4 | XP_001491550.2 |
| Sus scrofa | XM_001925664.5 | XP_001925699.2 |

It is noted that the GENBANK® biosequence database accession numbers provided in Table 2 represent the sequences of full-length ADAM9 gene products, of which the prodomain peptides are only a subsequence. For example, the human ADAM9 polypeptide sequence set forth in GENBANK® biosequence database accession number NP_003807.1 corresponds to the full length ADAM9 precursor protein of 819 amino acids and is set forth as SEQ ID NO: 1. The human ADAM9 prodomain peptide, on the other hand, corresponds to amino acids 30-203 of SEQ ID NO: 1, and is itself presented in SEQ ID NO: 2.

The terms "cancer" and "tumor" are used interchangeably herein and can refer to both primary and metastasized solid tumors and carcinomas of any tissue in a subject, including but not limited to breast; colon; rectum; lung; oropharynx; hypopharynx; esophagus; stomach; pancreas; liver; gallbladder; bile ducts; small intestine; urinary tract including kidney, bladder, and urothelium; female genital tract including cervix, uterus, ovaries (e.g., choriocarcinoma and gestational trophoblastic disease); male genital tract including prostate, seminal vesicles, testes and germ cell tumors; endocrine glands including thyroid, adrenal, and pituitary; skin (e.g., hemangiomas and melanomas), hone or soft tissues; blood vessels (e.g., Kaposi's sarcoma); brain, nerves, eyes, and meninges (e.g., astrocytomas, gliomas, glioblastomas, retinoblastomas, neuromas, neuroblastomas, Schwannomas and meningiomas). As used herein, the terms "cancer and "tumor" are also intended to refer to multicellular tumors as well as individual neoplastic or pre-neoplastic cells. In some embodiments, a cancer or a tumor comprises a cancer or tumor of an epithelial tissue such as, but not limited to a carcinoma. In some embodiments, a tumor is an adenocarcinoma, which in some embodiments is an adenocarcinoma of the pancreas, breast, ovary, colon, or rectum, and/or a metastatic cell derived therefrom.

As used herein, the term "wound" refers to multiple types of wounds including but not limited to abrasions, lacerations, contusions, burns, penetrating wounds, stab wounds, skin cuts, surgical wounds, bedsores (such as but not limited to pressure ulcers and decubitus ulcers), diabetic wounds and ulcers, fibrotic wounds, gunshot wounds (wounds resulting from firearms), thermal wounds (burns, sunburns and frostbite), chemical wounds, bites, and stings, and electrical wounds.

II. Modified ADAM9 Prodomain Peptides

The presently disclosed subject matter provides in some embodiments modified ADAM9 prodomain peptides that, as compared to their unmodified counterparts, have desirable biological activities. By way of example and not limitation, the modified ADAM9 prodomain peptides of the presently disclosed subject matter can be in some embodiments more or less sensitive to cleavage by furin and furin-like proteins, in some embodiments more or less sensitive to cleavage by meprin and meprin-like proteins, and in some embodiments more or less likely to form dimers and other multimers via cysteine crosslinking, either to themselves or other members of the ADAM family of proteins (including but not limited to ADAM9), and in some embodiments.

As used herein, the phrases "modified ADAM9 prodomain peptides", "modified ADAM9 peptides", "the ADAM9 modulating peptides", and the like refer to peptides that have one or more modifications of the amino acid sequences set forth in SEQ ID NO: 2 or SEQ ID NO: 3 and/or other modifications that result in some desirable biological or biochemical property of a modified ADAM9 peptide as compared to an ADAM9 peptide that does not have the modification(s), including but not limited to a wild type ADAM9 prodomain peptide upon which it is based. By way of example and not limitation, the types of modifications that can be introduced into the modified ADAM9 peptides of the presently disclosed subject matter include amino acid substitutions, deletions, additions, and other types of modifications designed to alter one or more biological or biochemical properties of a modified ADAM9 peptide such as but not limited to solubility in a given solvent (including but not limited to a biological fluid such as blood, serum, cerebrospinal fluid, etc.), a dissociation constant with respect to a binding partner, a half maximal inhibitory concentration (IC50) towards an enzyme (such as but not limited to ADAM9 or another member of the ADAM family of disintegrins and metalloproteinases), and/or to improve various pharmacokinetic properties of interest.

With respect to the modifications that are encompassed within the presently disclosed subject matter, there are at least three biologically relevant features of the members of the ADAM family such as ADAM9 that can be exploited to produce the modified ADAM9 peptides of the presently disclosed subject matter. By way of example and not limitation, ADAM9 proteins and prodomain peptides derived therefrom are characterized by recognition sites for furin and furin-life endoproteases, recognitions sites for meprin and meprin-like metallopeptidases, and numerous cysteine residues that can form homo- and heterodimers and higher order multimers via formation of disulfide bonds. Cleavage by furin and furin-like endoproteases and meprin and meprin-like metallopeptidases as well as disulfide bond formation is relevant to several of the biological activities of the members of the ADAM family such as ADAM9, and the amino acid sequences responsible for these activities can be modified in order to modulate the biological activities of the members of the ADAM family such as ADAM9.

For example, the wild type human ADAM9 prodomain peptide represented by SEQ ID NO: 2 has a furin recognition site at amino acids 24-27 of SEQ ID NO: 2. As disclosed herein, modifications of amino acids 24, 26, and/or 27 of SEQ ID NO: 2 results in modified ADAM9 peptides that have greater or lesser sensitivities to cleavage by furin and furin-like endoproteases. Similarly, the wild type human ADAM9 prodomain peptide represented by SEQ ID NO: 2 has four (4) meprin recognition sites: amino acids 5-7 of SEQ ID NO: 2 (referred to herein as the "first meprin site"); amino acids 60-62 of SEQ ID NO: 2 (referred to herein as the "second meprin site"); amino acids 136-138 of SEQ ID NO: 2 (referred to herein as the "third meprin site"); and amino acids 159-164 (referred to herein as the "fourth meprin site"). As disclosed herein, modifications of amino acids 6 and/or 7 of the first meprin site of SEQ ID NO: 2, and/or amino acids 61 and/or 62 of the second meprin site of SEQ ID NO: 2, and/or amino acids 137 and/or 138 of the third meprin site of SEQ ID NO: 2, and/or any one of amino acids 160-164 of the fourth meprin site of SEQ ID NO: 2, or any combination thereof, results in modified ADAM9 peptides that have greater or lesser sensitivities to inhibition and/or cleavage by meprin and meprin-like metallopeptidases. Also similarly, modifications of any of the cysteines of SEQ ID NO: 2 that are involved with disulfide bond formation, including but not limited to cysteines 85, 104, and 146 of SEQ ID NO: 2, results in modified ADAM9 peptides that have greater or lesser ability to form disulfide bonds with ADAM9 proteins and/or other ADAM family member proteins. As would also be understood by one of ordinary skill in the art, combinations of furin site modifications, meprin site modifications, and/or cysteines can result in modified ADAM9 peptides that have multiple new functionalities, as desired.

Therefore, in some embodiments, the ADAM9 modulating peptides of the presently disclosed subject flatter peptides with amino acid sequences derived from SEQ ID NO: 2 that include at least one amino acid substitution or other modification of at least one of amino acids 24, 26, and/or 27 of SEQ ID NO: 2 (i.e., the furin recognition sequence), at least one of amino acids 6, 7, 61, 62, 137, 138, and 160-164 of SEQ ID NO: 2 (i.e., the meprin recognition sequences), and/or at least one of cysteines 85, 104, and 146 of SEQ ID NO: 2. It is understood that modifications such as but not limited to amino acid substitutions can occur at any one or more of amino acids 6, 7, 24, 26, 27, 61, 62, 85, 104, 137, 138, 146, and 160-164 of SEQ ID NO: 2 in any combination, and all combinations and subcombinations of amino acid substitutions at any combination or subcombination of these amino acid positions are encompassed by the presently disclosed subject matter.

More particularly, the first meprin site of the ADAM9 prodomain is amino acids 5-7 of SEQ ID NO: 2, with amino acid 6 and/or amino acid 7 being substituted. In some embodiments, amino acid 6 and/or amino acid 7 is substituted with any amino acid. In some embodiments, amino acid 6 and/or amino acid 7 is independently substituted with asparagine, alanine, serine, or glycine.

Alternatively or in addition, substitutions can be introduced into the second meprin site of the ADAM9 prodomain, which is amino acids 60-62 of SEQ ID NO: 2, with amino acid 61 and/or amino acid 62 being substituted. In some embodiments, amino acid 61 and/or amino acid 62 is substituted with any amino acid. In some embodiments, amino acid 61 and/or amino acid 62 is independently substituted with asparagine, alanine, serine, or glycine.

Further alternatively or in addition, substitutions can be introduced into the third meprin site of the ADAM9 prodomain, which is amino acids 136-138 of SEQ ID NO: 2, with amino acid 137 and/or amino acid 138 being substituted. In some embodiments, amino acid 137 and/or amino acid 138 is substituted with any amino acid. In some embodiments, amino acid 137 and/or amino acid 138 is independently substituted with asparagine, alanine, serine, or glycine.

Even further alternatively or in addition, substitutions can be introduced into the fourth meprin site of the ADAM9 prodomain, which is amino acids 159-164 of SEQ ID NO:

2 (i.e., SEQ ID NO: 25), with one, two, three, four, or all five of amino acids 160-164 being substituted. In some embodiments, one, two, three, four, or all five of amino acids 160-164 is/are substituted with any amino acid. In some embodiments, one, two, three, four, or all five of amino acids 160-164 is/are independently substituted with asparagine, alanine, serine, or glycine. In some embodiments, at least three of amino acids 160-164 is/are substituted with any amino acid, which in some embodiments can independently be asparagine, alanine, serine, or glycine. As such, in some embodiments amino acids 159-164 of SEQ ID NO: 2 (i.e., SEQ ID NO: 25) are substituted to KXEXEX, KDXEXX, KDXXXE, KXEXXE, or KXXEXE, wherein X is in some embodiments any amino acid and in some embodiments each X is independently selected from the group consisting of asparagine, alanine, serine, or glycine. In some embodiments, at least four of amino acids 160-164 is/are substituted with any amino acid, which in some embodiments can independently be asparagine, alanine, serine, or glycine. As such, in some embodiments amino acids 159-164 of SEQ ID NO: 2 (i.e., SEQ ID NO: 25) are substituted to KDXXXX, KXEXXX, KXXEXX, KXXXEX, or KXXXXE, wherein X is in some embodiments any amino acid and in some embodiments each X is independently selected from the group consisting of asparagine, alanine, serine, or glycine. In some embodiments, all five of amino acids 160-164 is/are substituted with any amino acid, which in some embodiments can independently be asparagine, alanine, serine, or glycine. As such, in some embodiments amino acids 159-164 of SEQ ID NO: 2 (i.e., SEQ ID NO: 25) are substituted to KXXXX, wherein X is in some embodiments any amino acid and in some embodiments each X is independently selected from the group consisting of asparagine, alanine, serine, or glycine.

In addition to and/or alternatively to any of the meprin modifications described herein above, the meprin recognition site at amino acids 5-7 of SEQ ID NO: 2 can be modified, in some embodiments by substitution of the amino acid at position 6, the amino acid at position 7, or both. In some embodiments, the substitution of the amino acid at position 6, the amino acid at position 7, or both is any amino acid. In some embodiments, the substitution of the amino acid at position 6, the amino acid at position 7, or both is independently selected from the group consisting of asparagine, alanine, serine, or glycine.

In addition to and/or alternatively to any of the meprin and/or furin modifications described herein above, one or more of the cysteines involved in disulfide bond formation can be modified. In some embodiments, these cysteines include cysteines 85, 104, and/or 146 of SEQ ID NO: 2 in any combination or subcombination. Thus, in some embodiments the ADAM9 prodomain peptides of the presently disclosed subject matter include a modification of cysteine 85, a modification of cysteine 104, a modification of cysteine 146, modifications of both cysteines 85 and 104, modifications of both cysteines 104 and 146, or modifications of all of cysteines 85, 104, and 146. In some embodiments, the modifications at these cysteines are substitutions of any amino acid, with each of cysteines 85, 104, and 146 being independently substituted with the same or a different amino acid. In some embodiments, cysteines 85, 104, and/or 146 are independently substituted with serine.

In addition to the modifications at positions 6, 7, 24, 26, 27, 61, 62, 85, 104, 137, 138, 146, and 160-164 of SEQ ID NO: 3, other modifications of the amino acid sequence of SEQ ID NO: 3 can be introduced. By way of example and not limitation, one or more amino acids (in some embodiments, 1, 2, 3, 4, 5, or more amino acids) can be added to the N-terminus and/or the C-terminus of a peptide of SEQ ID NO: 3. By way of additional example and not limitation, a cysteine residue alone or in combination with other amino acids can be added to the N-terminus and/or the C-terminus to provide a functionality known to be possessed by cysteine residues. For example, a cysteine residue alone or in combination with other amino acids can be added to the N-terminus and/or the C-terminus to provide a site for pegyCation of an ADAM9 modulating peptide. Exemplary pegylation sites include but are not limited to a single cysteine residue at the N-terminus and/or the C-terminus, the pentapeptide of SEQ ID NO: 26, and/or the pentapeptide of SEQ ID NO: 27.

Thus, in some embodiments an ADAM9 modulating peptide can be conjugated to a PEG group of about 1-40 kDa, in some embodiments by adding a peptide sequence to the N- and/or the C-terminus that includes a cysteine to which a PEG group can be attached. The ADAM9 modulating peptides of the presently disclosed subject matter can include peptides containing additional sequences (e.g., amino acids) on the N- and/or the C-terminus that are necessary for successful expression of the ADAM9 modulating peptides in E. coli, insect cells, mammalian systems, etc. In addition, one or more tags can be added which aid in the purification of the ADAM9 modulating peptides of the presently disclosed subject matter. The tags can include, but are not limited to, His tags, C-myc tags, Flag tags, HA tags, Streptactin tags, Disulfide tags, and Biotin tags. The sequences between the tag(s) and the prodomain peptides can in some embodiments comprise protease cleavage sites, such as those found for enterokinase, thrombin, and/or Tev proteases. The ADAM9 modulating peptides of the presently disclosed subject matter may include modifications that stabilize the peptide for in vivo use. Such modifications are generally known to those of skill in the art and include, but are not limited to, modification with fatty acids and pegylation, incorporation of D amino acids, and substitution, deletion, and/or addition of amino acids.

Modifications and changes can be made in the structure of an ADAM9 modulating peptides of the presently disclosed subject matter and still obtain a molecule having ADAM9 modulating properties. For example, certain amino acids can be substituted for other amino acids in a sequence without appreciable loss of peptide activity. Because it is the interactive capacity and nature of a polypeptide that defines that polypeptide's biological functional activity, certain amino acid sequence substitutions can be made in a polypeptide sequence (or, of course, its underlying DNA coding sequence) and nevertheless obtain a polypeptide with ADAM9 modulating properties.

In making such changes, the hydropathic index of amino acids can be considered. The importance of the hydropathic amino acid index in conferring interactive biologic function on a polypeptide is generally understood in the art (Kyte & Doolittle, 1982). It is known that certain amino acids can be substituted for other amino acids having a similar hydropathic index or score and still result in a polypeptide with similar biological activity. Each amino acid has been assigned a hydropathic index on the basis of its hydrophobicity and charge characteristics. Those indices are: isoleucine (+4.5); valine (+4.2), leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5).

It is believed that the relative hydropathic character of the amino acid determines the secondary structure of the resultant polypeptide, which in turn defines the interaction of the polypeptide with other molecules, such as enzymes, substrates, receptors, antibodies, antigens, and the like. It is known in the art that an amino acid can be substituted by another amino acid having a similar hydropathic index and still obtain a functionally equivalent polypeptide. In such changes, the substitution of amino acids whose hydropathic indices are within ±2 is preferred, those which are within ±1 are particularly preferred, and those within ±0.5 are even more particularly preferred.

Substitution of like amino acids can also be made on the basis of hydrophilicity, particularly where the biological functional equivalent polypeptide or peptide thereby created is intended for use in immunological embodiments. U.S. Pat. No. 4,554,101, incorporated herein by reference, states that the greatest local average hydrophilicity of a polypeptide, as governed by the hydrophilicity of its adjacent amino acids, correlates with its immunogenicity and antigenicity: i.e., with a biological property of the polypeptide. As detailed in U.S. Pat. No. 4,554,101, the following hydrophilicity values have been assigned to amino acid residues: arginine (+3.0); lysine (+3.0); aspartate (+3.0±1); glutamate (+3.0±1); serine (+0.3); asparagine (+0.2); glutamine (+0.2); glycine (0); proline (−0.5±1); threonine (−0.4); alanine (−0.5); histidine (−0.5); cysteine (−1.0); methionine (−1.3); valine (−1.5); leucine (−1.8); isoleucine (−1.8); tyrosine (−2.3); phenylalanine (−2.5); tryptophan (−3.4). It is understood that an amino acid can be substituted for another having a similar hydrophilicity value and still obtain a biologically equivalent, and in particular, an immunologically equivalent polypeptide. In such changes, the substitution of amino acids whose hydrophilicity values are within ±2 is preferred, those which are within ±1 are particularly preferred, and those within ±0.5 are even more particularly preferred.

As outlined above, amino acid substitutions are generally therefore based on the relative similarity of the amino acid side-chain substituents, for example, their hydrophobicity, hydrophilicity, charge, size, and the like. Exemplary substitutions which take various of the foregoing characteristics into consideration are well known to those of skill in the art and include: arginine and lysine; glutamate and aspartate; serine and threonine; glutamine and asparagine; and valine, leucine and isoleucine (see Table 3, below). The presently disclosed subject matter thus contemplates functional or biological equivalents of a peptide as set forth above.

TABLE 3

Exemplary Amino Acid Substitutions

| Original Residue | Exemplary Substitutions |
|---|---|
| Ala | Gly; Ser |
| Arg | Lys |
| Asn | Gln; His |
| Asp | Glu |
| Cys | Ser |
| Gln | Asn |
| Glu | Asp |
| Gly | Ala |
| His | Asn; Gln |
| Ile | Leu; Val |
| Leu | Ile; Val |
| Lys | Arg |
| Met | Leu; Tyr |
| Ser | Thr |
| Thr | Ser |
| Trp | Tyr |

TABLE 3-continued

Exemplary Amino Acid Substitutions

| Original Residue | Exemplary Substitutions |
|---|---|
| Tyr | Trp; Phe |
| Val | Ile; Leu |

Biological or functional equivalents of a peptide or polypeptide can be prepared using site-specific mutagenesis according to procedures well known in the art. Accordingly, amino acid residues can be added to or deleted from the ADAM9 modulating peptides of the presently disclosed subject matter through the use of standard molecular biological techniques without altering the functionality of the peptide. Specific examples include the human ADAM9 prodomain peptides of the presently disclosed subject matter.

In some embodiments, the ADAM9 prodomain peptide of the presently disclosed subject matter consists of, consists essentially of, or comprises an amino acid sequence as set forth in any of SEQ ID NOs: 3-23 and 28-430,947 or is an ADAM9 prodomain peptide having at least 87%, 88%, 89%, 90%, 91%, 92%, 93%, 94%, 95%, 96%, 97%, 98%, 99%, or 100% homology to any one of SEQ ID NOs: 3-23 and 28-430,947. In some embodiments, the ADAM9 prodomain peptide comprises one of SEQ ID NOs: 3-23 and 28-430,947 or is an ADAM9 modulating peptide having at least 87%, 88%, 89%, 90%, 91%, 92%, 93%, 94%, 95%, 96%, 97%, 98%, 99%, or 100% homology to one of SEQ ID NOs: 3-23 and 28-430,947 and is pegylated.

In view of the above, exemplary modified ADAM9 peptides of the presently disclosed subject matter can comprise, consist essentially of, and/or consist of the amino acid sequences set forth in any of SEQ ID NOs: 3-23 and 28-430,947, SEQ ID NO: 3 is a general consensus sequence, wherein positions 6, 7, 24, 26, 27, 61, 62, 85, 104, 137, 138, 146, and 160-164 can be substituted with any amino acid, as set forth herein. Other non-limiting exemplary modified ADAM9 peptides of the presently disclosed subject matter can comprise, consist essentially of, or consist of amino acid sequences with the following substitutions with respect to SEQ ID NO: 3:

one, two, or all three of cysteines 85, 104, and 146 of SEQ ID NO: 3 is/are subs ed with serine and arginine 26 is substituted with alanine;

cysteine 146 of SEQ ID NO: 3 is substituted with serine, arginine 26 is substituted with alanine, and cysteines 85 and 104 are both substituted with PEG groups of about 1-40 kDa, which in some embodiments improve the in vitro and/or in vivo biological and/or biochemical properties of the modified ADAM9 peptides;

cysteine 85, cysteine 104, and cysteine 146 are all substituted with serines and arginine 24 is substituted with alanine;

cysteine 85, cysteine 104, and cysteine 146 are all substituted with serines and arginine 26 is substituted with alanine;

cysteine 85, cysteine 104, and cysteine 146 are all substituted with serines and arginine 27 is substituted with alanine;

cysteine 85, cysteine 104, and cysteine 146 are all substituted with serines and one or more arginines of amino acids 24, 26, and/or 27 is/are substituted with alanine or any amino acid that reduces or eliminates furin or PC convertase cleavage, optionally with a cysteine placed at the C-terminus after amino acid 174;

cysteine 85, cysteine 104, and cysteine 146 are all substituted with serines and one or more arginines of amino acids 24, 26, and/or 27 is/are substituted with alanine or any amino acid that reduces or eliminates furin or PC convertase cleavage, optionally with a cysteine placed at the N-terminus before amino acid 1;

cysteine 85 and cysteine 104 are substituted with serines, one or more arginines of amino acids 24, 26, and/or 27 is/are substituted with alanine, and cysteine 146 is pegylated with a PEG group of about 1-40 kDa;

cysteine 85, cysteine 104, and cysteine 146 are all substituted with serines; and one or more arginines of amino acids 24, 26, and/or 27 is/are substituted, optionally with alanine to reduce or eliminate furin cleavage or PC convertase, and one or more of cysteines 85, 104, and 146 are modified to include a maleimide ester such as but not limited to a small molecule alkyl ester or ester that have functional groups or colorimetric, fluorescent, or radiolabel groups attached which would render the cysteines resistant to oxidation.

In some embodiments, the presently disclosed subject matter provides pharmaceutical compositions comprising an ADAM9 modulating peptide and a physiologically acceptable carrier. In some embodiments, the pharmaceutical composition comprises an ADAM9 modulating peptide consisting or, consisting essentially of, and/or comprising the amino acid sequence set forth in SEQ ID NOs: 3-23 and 28-430,947.

A composition of the presently disclosed subject matter is typically administered parenterally in dosage unit formulations containing standard, well-known nontoxic physiologically acceptable carriers, adjuvants, and vehicles as desired. The term parenteral as used herein includes intravenous, intramuscular, intraarterial injection, intraperitoneal, topical, or infusion techniques.

Injectable preparations, for example sterile injectable aqueous or oleaginous suspensions, are formulated according to known techniques using suitable dispersing or wetting agents and suspending agents. The sterile injectable preparations can also be sterile injectable solutions and/or suspensions in a nontoxic parenterally acceptable diluent or solvent, for example, as a solution in 1,3-butanediol.

Exemplary, non-limiting acceptable vehicles and solvents that may be employed are water, Ringer's solution, and isotonic sodium chloride solution. In addition, sterile, fixed oils are conventionally employed as solvents or suspending media. For this purpose, any bland fixed oil can be employed including synthetic mono- or di-glycerides. In addition, fatty acids such as oleic acid find use in the preparation of injectables. Preferred carriers include neutral saline solutions buffered with phosphate, lactate, Tris, and the like.

III. Methods for Use and Uses of the Modified ADAM9 Prodomain Peptides of the Presently Disclosed Subject Matter The ADAM9 modulating peptides of the presently disclosed subject matter and compositions comprising or consisting essentially thereof are useful for modulating ADAMS protein activity in vitro and in vivo. In some embodiments, the presently disclosed subject matter provides a method for modulating ADAM9 activity in vitro comprising contacting an ADAM9 modulating prodomain peptide with a solution or a cell comprising an ADAM9 protein under conditions and in an amount sufficient (referred to herein as "an effective amount" or, in the case of a treatment or preventive method, a "therapeutically effective amount") to modulate the activity of the ADAM9 protein.

In some embodiments, the presently disclosed subject matter provides a method for modulating ADAM9 activity in vivo, the method comprising administering to a subject a composition (in some embodiments a pharmaceutical composition) comprising an ADAM9 to modulating prodomain peptide in a therapeutically effective amount and via a route of administration sufficient to modulate ADAM9 activity. In some embodiments, the subject has a disease or disorder characterized at least in part by the presence of an excess of an ADAM9 biological activity (i.e., an undesirable level of an ADAM9 biological activity). In some embodiments, the disorder is characterized by one or more of inflammation, an allergic response, asthma, angiogenesis, an infectious disease, cancer, a predisposition thereto, and/or a symptom or consequence thereof. In some embodiments, the disorder is a cancer and the symptom or consequence thereof comprises fibrosis.

Thus, in some embodiments the disease or disorder is characterized by one or more of Alzheimer's disease, cancer, inflammation, COPD, neovascular diseases, or a predisposition thereto, and/or a symptom or consequence thereof.

EXAMPLES

The following EXAMPLES provide illustrative embodiments. In light of the present disclosure and the general level of skill in the art, those of skill will appreciate that the following Examples are intended to be exemplary only and that numerous changes, modifications, and alterations can be employed without departing from the scope of the presently disclosed subject matter.

Example 1

The Human Prodomain Peptides of ADAM9 Inhibits ADAM9 In Vitro

An ADAM9 prodomain peptide was prepared by cloning a nucleic acid sequence encoding SEQ ID NO: 2 along with a $His_6$ tag (SEQ ID NO: 24) into a plasmid expression vector. Some prodomain peptides were prepared by transformation of BL21DE3 cells followed by expression at 16° C. This yielded both soluble prodomain peptide and prodomain peptide in inclusion bodies. Others were prepared by expression at 37° C. which yielded inclusion bodies. The soluble prodomain peptide was purified by lysing the bacteria in 20 mM Tris pH 8 with or without 2-5 mM Tris(2-carboxyethyl)phosphine (TCEP; Gold Biotechnology, Inc., St. Louis, Missouri, United States of America) with 1 mg/ml lysozyme (Sigma-Aldrich Corp., St. Louis, Missouri, United States of America), benzonase,(Sigma-Aldrich) protease inhibitor cocktail (Gold Biotechnology), and 1× CELLLYTIC® solution (Sigma-Aldrich) for 15-40 minutes at room temperature. The pellet after centrifugation was again treated with the same buffer and centrifuged once more. For soluble protein, the first or both supernatants were applied to a Ni-NTA column (Fisher Scientific, Philadelphia, Pennsylvania, United States of America). After washing, the prodomain was eluted with 2 M imidazole, 20 mM Tris, pH 9 and with or without 5 mM TCEP. The material was then passed over a SUPERDEX® 200 brand column (GE Healthcare Bio-Sciences, Pittsburgh, Pennsylvania, United States of America) equilibrated in 20 mM Tris pH 8 and 40 mM NaCl. After concentration and endotoxin removal, glycerol was added to 10% and the material was stored at −20° C.

The inclusion bodies were prepared by breaking open the bacteria as described above, and then the material was centrifuged for 30 minutes at 3,000 rpm. The pellet was then resuspended in the lysis buffer, and rocked for 30 minutes at room temperature before spinning again to pellet the inclusion bodies. Prodomains were purified from inclusion bodies by solubilization in 8 M urea, 20 mM Tris pH 8, with or without 2-4 mM TCEP, and then rocked with Ni-NTA beads from Fisher Scientific (Waltham, Massachusetts, United States of America). Beads were washed with several volumes of 8 M urea, 20 mM Tris, with or without TCEP and then the material was eluted in 6 M urea and 20 mM Tris pH 9 with or without 2-4 mM TCEP and 666 mM imidazole pH 9. The prodomains were refolded from urea and then dialyzed to remove the remaining urea and imidazole using 20 mM Tris buffer pH 8. Prodomains were concentrated after dialysis and incubated at varying concentrations with human or mouse ADAM9 in 20 mM Tris pH 8 and 0.001% BRIJ® 35 brand detergent in a black coated 96-well plate with 10 µM PEPDAB064, a fluorescence energy transfer substrate for ADAM family members (BioZyme Inc, Apex, North Carolina, United States of America). Data was fit to determine 1050 values using Prism software. The results are presented in Table 4.

TABLE 4

IC50 values for Inhibition of ADAM9

| Construct | Purification | IC50 (nM) |
|---|---|---|
| SEQ ID NO: 2 (wild type) | Inclusion bodies | 20 ± 6 |
| SEQ ID NO: 9 | Inclusion bodies | 66% inhibition at 46 nM |
| SEQ ID NO: 10 | Soluble fraction | 49 ± 8 |
| SEQ ID NO: 10 | Inclusion bodies | >200 nM |
| SEQ ID NO: 11 | Soluble fraction | 13.8 ± 3.9 |
| SEQ ID NO: 11 | Inclusion bodies | >200 nM |
| SEQ ID NO: 12 | Soluble fraction | 39 ± 6.2 |
| SEQ ID NO: 12 | Inclusion bodies | 41 ± 10.5 |
| SEQ ID NO: 13 | Inclusion bodies | 46 ± 9 |
| SEQ ID NO: 14 | Inclusion bodies | 136 ± 36 |
| SEQ ID NO: 15 | Inclusion bodies | 66% inhibition at 46 nM |
| SEQ ID NO: 16 | Inclusion bodies | 29 ± 3.6 |
| SEQ ID NO: 17 | Inclusion bodies | 185 ± 57 |
| SEQ ID NO: 18 | Inclusion bodies | 181 ± 61 |
| SEQ ID NO: 19 | Inclusion bodies | 33 ± 6 |
| Chemically modified SEQ ID NO: 2 | Inclusion bodies | 125 ± 68 |
| pegylated SEQ ID NO: 20 | Inclusion bodies | 16 ± 3 |
| pegylated SEQ ID NO: 21 | Inclusion bodies | 40.5 ± 14 |
| pegylated SEQ ID NO: 22 | Inclusion bodies | 60 ± 8.8 |
| pegylated SEQ ID NO: 23 | Inclusion bodies | 39.9 ± 8.2 |

Example 2

Selectivity Profile

For determination of specificity, wild type human ADAM9, or SEQ ID NO: 10 were incubated with either ADAM10 or ADAM17 (R & D Systems, Minneapolis, Minnesota, United States of America) with the same substrate buffer mix (at greater than 2 µM concentrations) as described for ADAM9. They were also tested against MMP1, MMP2, MMP9, and MMP14 using 15 µM PEPDAB008, BioZyme Inc (Apex, North Carolina, United States of America) in 20 mM Tris/150 mM NaCl/10 µM CaCl$_2$ with 0.001% BRIJ® 35 brand detergent. There was no inhibition of any of the enzymes tested.

Example 3

Dimerization and Multimerization of Prodomain Due to Oxidation

Figure 2:
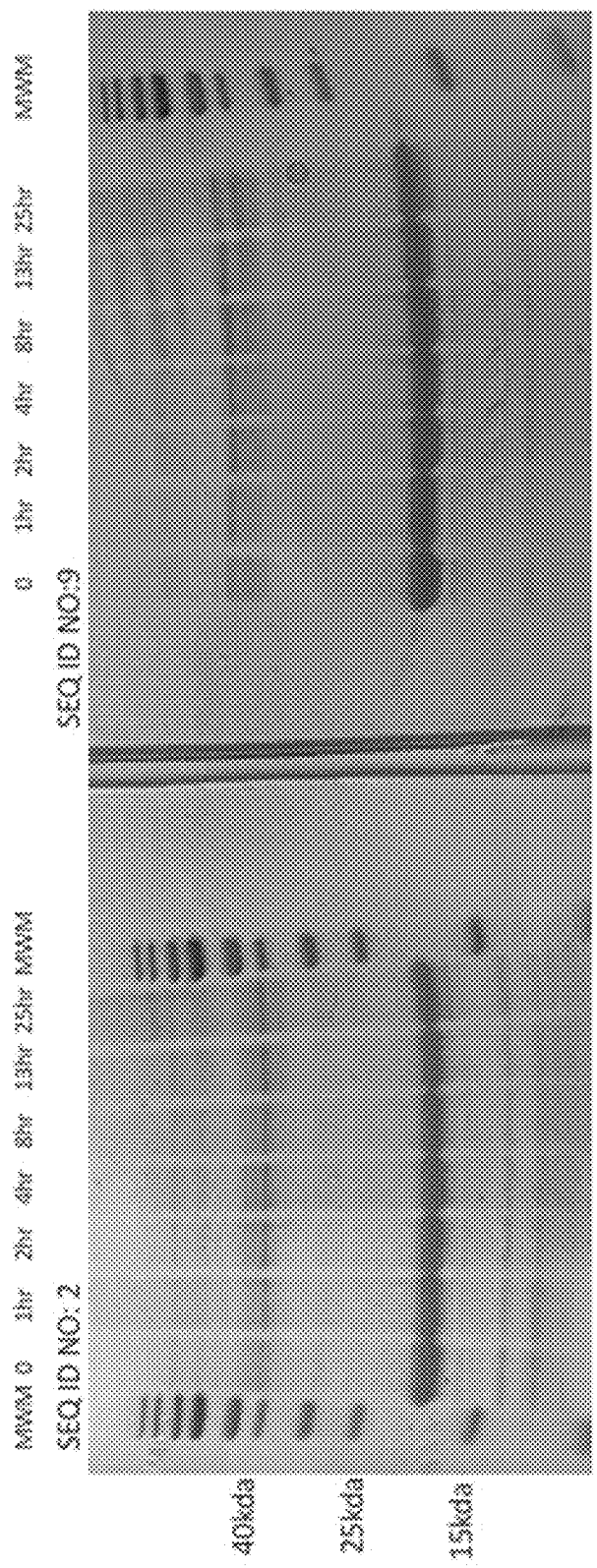
FIG. 2 is an SDS PAGE gel of freshly refolded and dialyzed SEQ ID NO: 2 or SEQ ID NO: 10 (0.5 µg/µl) after varying incubation times at 37° C. in 20 mM Tris buffer pH 8. Protein dimerization and trimerization were visualized by running the SDS PAGE gel followed by staining with SimplyBlue (Fisher Scientific, Pittsburg, PA). MWM indicates prestained molecular weight markers. Both peptides contained free sulfhydryl groups (SEQ ID NO: 9 has a C146S mutation) and were susceptible to oxidation with the amounts of dimer and trimer formation increasing with time.

The wild type prodomain peptide (SEQ ID NO: 2) has three cysteines. All of these cysteines are free and not in disulfide bonds as assessed by the Eilman's Reagent test. Upon incubation in the 1.5 cold, or at higher temperatures, or upon storage frozen at −20° C., the protein sulfhydryl groups reacted with one another upon oxidation to form disulfide bonds (see FIG. 1). The IC50 for inhibition of ADAM9 was typically around 20 nM when it is freshly prepared after removing reducing agents. However, upon dialysis and assaying 1 week later, even if it has been frozen, dimer formation occurred and the IC50 increased to 120 nM. Eventually after storage for 1 month at −20° C., the protein dimerized and trimerized even further, where it eventually precipitated upon thawing. Also, after incubation at 37° C. for 0-25 hours, dimer and trimer formation increased for wild type prodomain (SEQ ID NO: 2) and SEQ ID NO: 9, which has a cysteine to serine substitution at position 146 (see FIG. 2) but still retains cysteines at amino acid positions 85 and 104.

Example 4

Pegylation of the Prodomain Allowed for Proper Refolding and Improved Potency After Purification from Inclusion Bodies SEQ ID NO: 10, after elution from Ni-NTA beads in 8 M urea, 20 mM Tris, and 666 mM imidazole, pH 9, was diluted into 20 mM Tris pH9 and left overnight at 4° C. The material was then concentrated, and passed over a SUPERDEX® 200 brand sizing column equilibrated in 20 mM Tris, pH 8, 40 mM NaCl. Most of the material came off the column near the void volume, indicating it was aggregating. Fractions were combined and concentrated. An IC50 value was determined by incubation of ADAM9 with varying concentrations of prodomain. The IC50 was greater than 200 nM (see Table 4), whereas the soluble version of SEQ ID NO: 10 had an 1050 value of 49 nM (see Table 4).

A version of SEQ ID NO: 10 having a cysteine on its C terminus (SEQ ID NO: 20) was solubilized from inclusion bodies and purified with Ni-NTA beads as described in EXAMPLE 1 and then passed through a ZEBA™ brand spin column equilibrated in urea and phosphate buffer. An excess 20 kDa maleimide PEG (Nanocs Inc, Boston, Massachusetts, United States of America) was added. After 2 hours, the reaction progress was terminated by addition of TCEP to 10 mM. The TCEP was incubated with the prodomain for 1 more hour, after which time, material was refolded and passed over a SUPERDEX® G200 brand column equilibrated in 20 mM Tris, pH 8 and 40 mM NaCl. Fractions containing the pure pegylated material were concentrated and passed through the sizing column twice more. Purified fractions were frozen at −20° C. after addition of glycerol. Pegylated SEQ ID NO: 20 inhibited ADAM9 with an IC50 of 16±3 nM. As a comparison, soluble SEQ ID NO: 10 had an IC50 of 49±8 nM and the material refolded from inclusion bodies did not inhibit ADAM9.

Example 5

Cysteine Modifications

WT prodomain (SEQ ID NO: 2) was passed over a ZEBA™ brand desalting spin column equilibrated in urea and phosphate buffer. 10 µg prodomain was reacted at 4° C. with 2 µg of ALEXA FLUOR® 647 brand maleimide ester (Fluoroprobes, Scottsdale, Arizona, United States of America) that can specifically react with sulfhydryl groups. After 3.5 hours, TCEP was added to 20 mM and the reaction was allowed to sit for an additional hour at 4° C. The material was then refolded and dialyzed.

Figure 3:
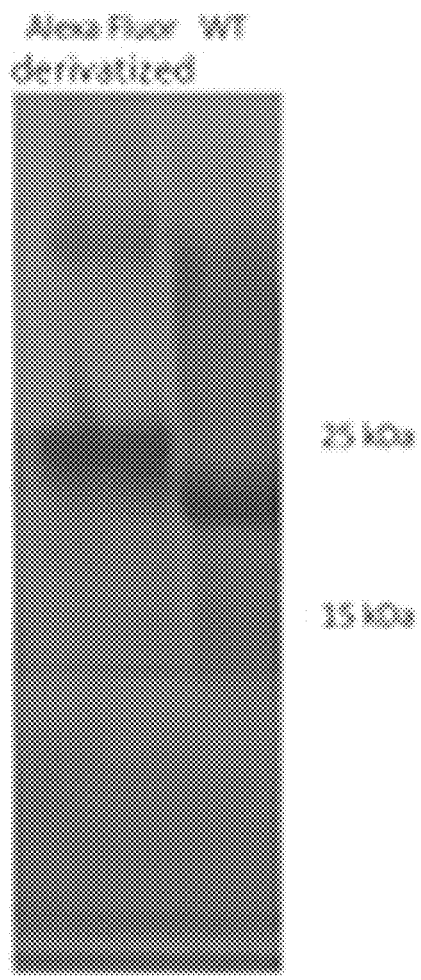
FIG. 3 depicts a stained gel showing the efficient labeling of a wild type ADAM9 prodomain peptide (SEQ ID NO: 2) with an ALEXA FLUOR® 647 brand maleimide ester fluorophore. There was little to no dimer nor starting material present in the modified SEQ ID NO: 2, indicating that the labeling was complete. In addition, the molecular weight shifted about 3 kDa higher, indicating that the prodomain was successfully modified on its three cysteines (i.e., the prodomain also had no free sulfhydryl groups as measured with Ellinan's Reagent).

An in vitro assay was used to determine the IC50 for inhibition of ADAM9 (IC50 125±68 nM). Ellman's Reagent was used to assess the content of free sulfhydryl groups after the reaction. Approximately 1-3% of the material was unreacted. An SDS gel was run to confirm labeling had occurred. The results are presented in FIG. 3. There was no detectable starting material, and the molecular weight of the prodomain, shifted to a higher molecular of about 3 kDa, indicating that the protein was labelled correctly.

Example 6

Cleavage Experiments

There is an upstream site in the prodomain of ADAM9 and that it is cleaved by furin. It was hypothesized that modifications at this site could improve IC50s of inhibition of shedding events or pharmacokinetic properties by prodomains of ADAM9. 50 µg, of each prodomain was reacted in a volume of approximately 100 µl in 1.7 ml Eppendorf tubes with furin or meprin. For the furin assays, the buffer was 20 mM Tris pH 8/150 mM NaCl/10 mM $CaCl_2$. The meprin buffer was 20 mM Tris pH 8, Samples were incubated at 37° C. and a time course was run by removing approximately 20-30 µl of solution and quenching with 10 µl of a 4× solution of loading dye. Samples were run on a 16% Nowex gel and stained with SimplyBlue SafeStain (Thermo Fisher Scientific).

Figure 4:
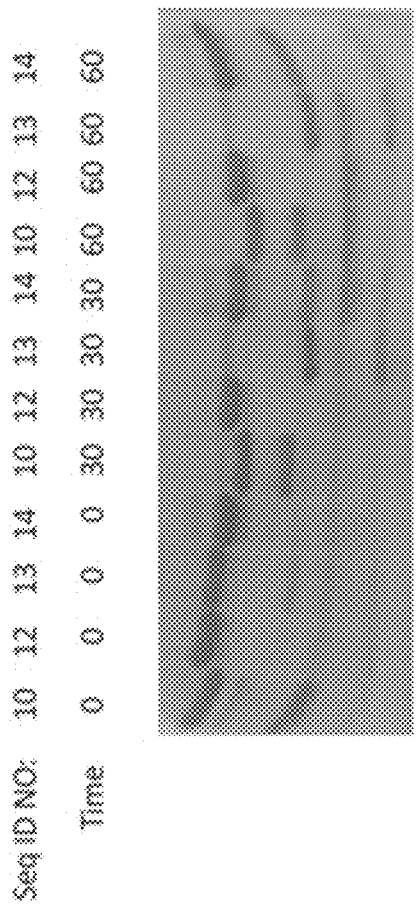
FIG. 4 depicts a stained gel showing cleavage of various modified ADAM9 prodomain peptides with furin at 0, 30, and 60 minutes, SEQ ID NO: 12 was the most stable mutant. In addition, the other furin mutants were also less resistant to cleavage as compared to the non-furin mutant SEQ ID NO: 13.
Figure 5:
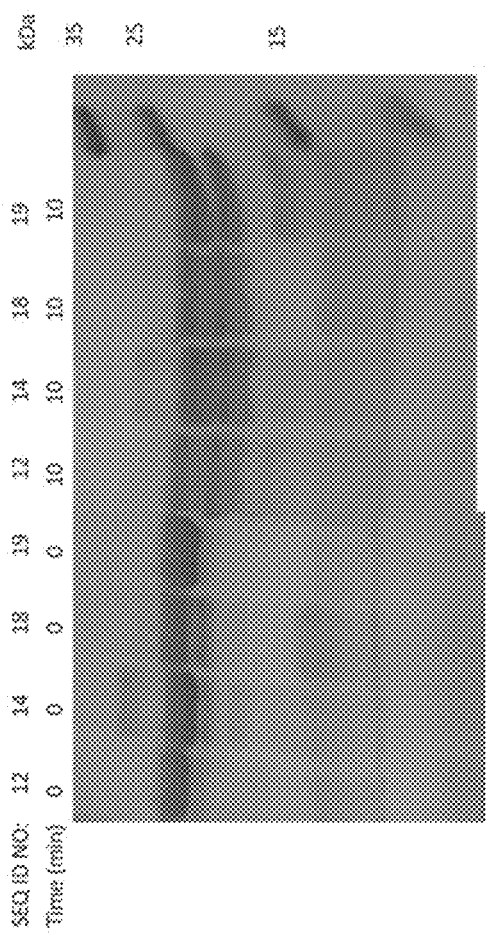
FIG. 5 depicts a stained gel showing cleavage of various modified ADAM9 prodomain peptides with meprin at 0 and 10 minutes. The far right lane is a molecular weight marker, with the positions of the bands that correspond to 15 kDa, 25 kDa, and 35 kDa markers labeled. SEQ ID NO: 12, which has no meprin mutations, was less stable relative to all the meprin mutants shown.
Figure 6:
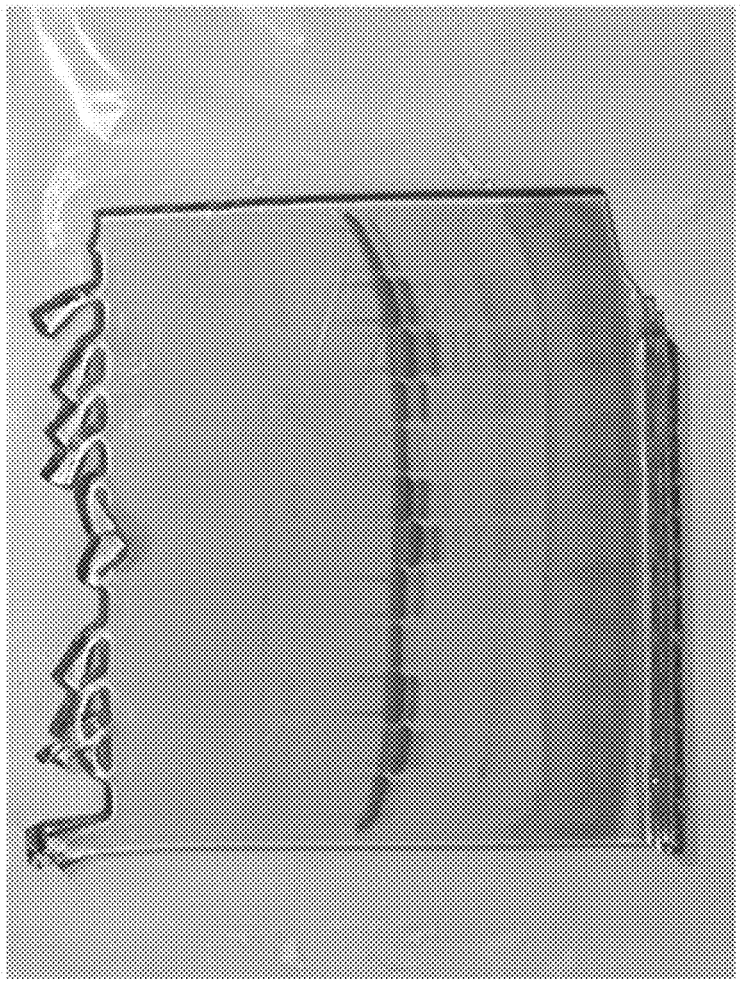
FIG. 6 depicts a stained gel showing cleavage of various modified ADAM9 prodomain peptides with meprin at 0, 10, and 40 minutes. SEQ ID NO: 19, which had substitutions at amino acids 161 and 163, was the most stable relative to modifications at amino acids 62 or 138.
Figure 7:
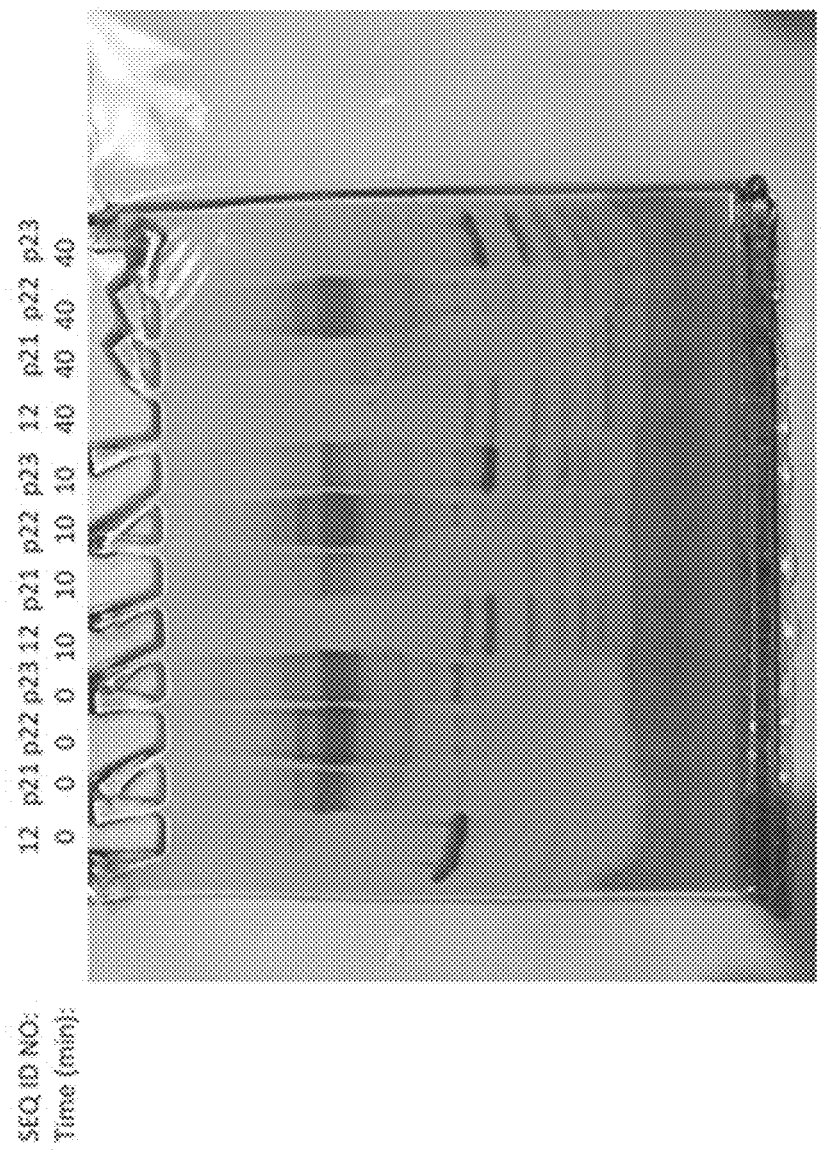
FIG. 7 depicts a stained gel showing cleavage of various modified ADAM9 prodomain peptides that were non-pegylated or pegylated with meprin at 0 and 10 minutes. SEQ ID NO: 12 represents a non-pegylated peptide whereas the "p" preceding SEQ ID NOs: 21-23 indicates that these peptides were pegylated, SEQ ID NO: 21 at cysteine 146, SEQ ID NO: 22 at the N-terminus, and SEQ ID NO: 23 at the C-terminus.

Results shown in FIG. 4 for furin and FIGS. 5-7 for meprin. The results indicated that the mutants were resistant to cleavage by furin. SEQ ID NO: 12 was the most stable. SEQ ID NO: 10, SEQ ID NO: 14, and SEQ ID NO: 11 were still cleaved by furin, but to a much lesser extent that SEQ ID NO:13 which had no furin mutation.

Figure 8:
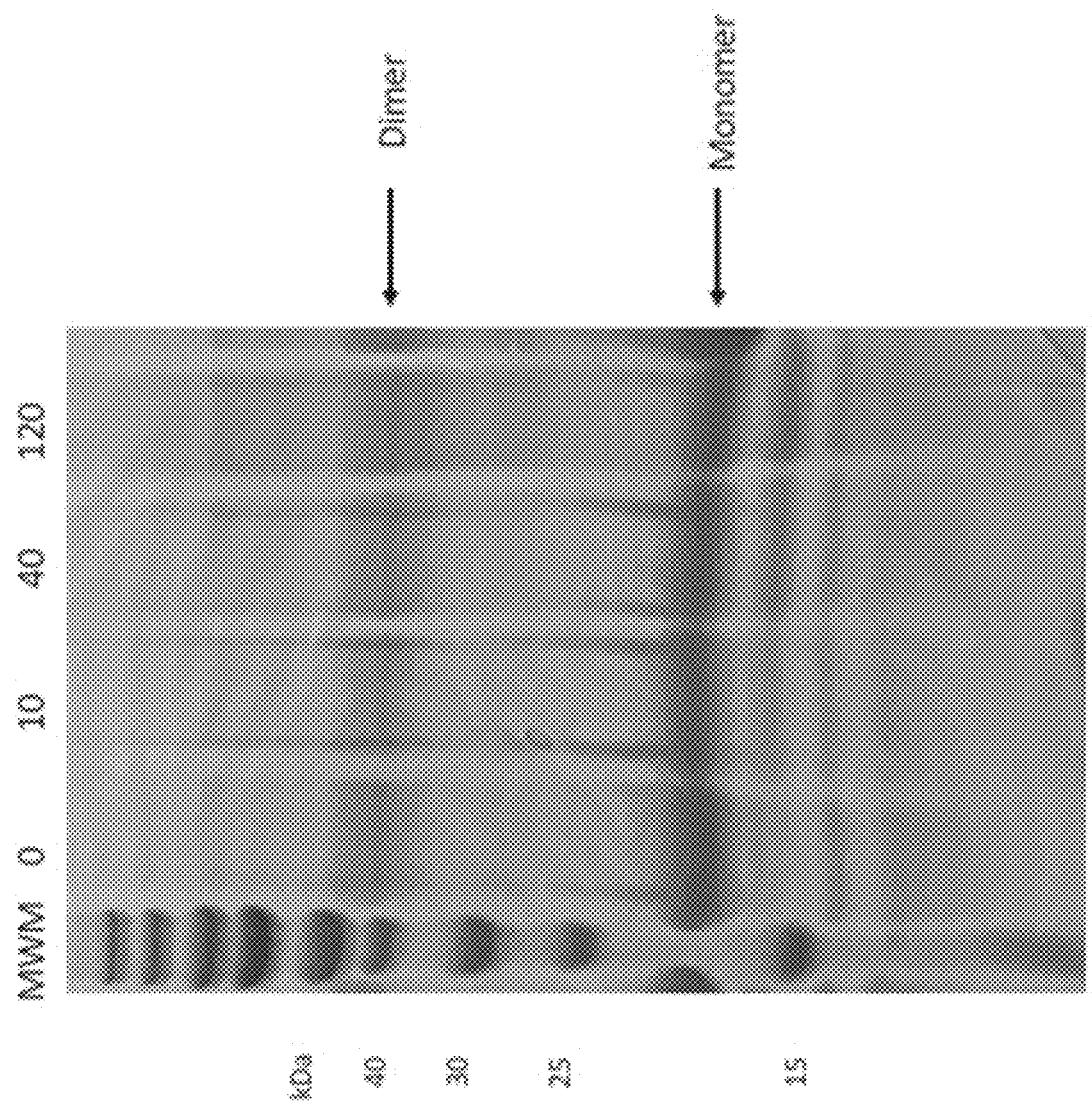
FIG. 8 depicts a stained gel showing cleavage of a wild type ADAM9 prodomain peptide with meprin at 0, 10, 40, and 120 minutes. The positions of the prodomain monomers and dimers are labeled. The far left lane is a molecular weight marker, with the positions of the bands that correspond to 15 kDa, 25 kDa, 30 kDa, and 40 kDa markers labeled. The gel shows that wild type ADAM9 prodomain peptide was cleaved by meprin.

Meprin was shown to cleave the ADAM10 prodomain but it is unknown if meprin also cleaves the prodomain of ADAM9. Improving the selectivity of the prodomains towards preventing inhibition of meprin while also improving the stability towards cleavage was tested. FIG. 8 shows that the wild type prodomain (SEQ ID NO: 2) was cleaved by meprin.

There are at least four possible meprin sites in SEQ ID NO: 2. Modifications were made to each site. Site one was deleted so that the prodomain started after amino acids 1-6 in SEQ ID NO: 2: (see SEQ ID NO: 17). The second site was mutated from PED (amino acids 60-62 of SEQ ID NO: 2) to PEA (see SEQ ID NO: 14). The third site (amino acids 136-138 of SEQ ID NO: 2) was modified from MDD to MDS (see SEQ ID NO: 18) and the final site (aa 159-164) was modified from KDEEEE (SEQ ID NO: 25) to KDNENE (see SEQ ID NO: 19). Based on the cleavage of SEQ ID NO: 2, it was hypothesized that the initial cleavage was occurring at site 4 (amino acids 159-164). The meprin mutants were more stable than the non-meprin mutants (FIG. 5; compare SEQ ID NO: 12 to SEQ ID NO: 14, SEQ ID NO: 18, and SEQ ID NO: 19.) Furthermore, non-meprin mutants that were pegylated were more resistant to meprin cleavage, especially pegylated SEQ ID NO: 22 which had a N-terminal pegylation site (see FIG. 7). Unexpectedly, pegylation at the N-terminus protected the prodomain from C-terminal cleavage. In contrast, neither of the C-terminal pegylated prodomains were protected from C-terminal cleavage. From the cleavage products that were formed, it can be determined that the C-terminus is the initial cleavage site presumably at the KDEEEE (SEQ ID NO: 25) motif. Modification of this site to KDNENE, reduced the cleavage rate (see SEQ ID NO: 19; FIG. 6) and increased the potency towards ADAM9 (see Table 4).

Example 7

Inhibition of Meprin beta by Prodomains

Human Meprin beta (R & D Systems, Minneapolis, Minnesota, United States of America) was activated according to the manufacturer's instructions with trypsin followed by quenching with 1 mM 4-(2-aminoethyl)benzenesulfonyl fluoride hydrochloride (AEBSF; Thermo Fisher Scientific). Prodomains were incubated at room temperature at varying concentrations with activated Meprin beta and the fluorescent substrate PEPDAB022 (BioZyme Inc, Apex, North Carolina, United States of America) at 15 µM in 20 mM Tris pH 8, 0.001% BRIJ® 35 brand detergent in a 96-well black coated plate. Low concentrations of Meprin beta and short reaction times were used to try to avoid cleavage of the prodomains under these conditions. Reaction rates were linear with time and did not show time-dependent activation.

TABLE 5

| IC50 for Inhibition of Meprin beta | |
|---|---|
| Construct | IC50 vs Meprin |
| WT (SEQ ID NO: 2) | 200 nM |
| 25 (SEQ ID NO: 12) | 7.4 µM |
| 25-1 (SEQ ID NO: 21) | 2.8 µM |
| 25-2 (SEQ ID NO: 22) | 3.8 µM |
| 25-3 (SEQ ID NO: 23) | 5.7 µM |
| 27 (SEQ ID NO: 14) | 14% at 5.7 µM |
| 31 (SEQ ID NO: 18) | 33% at x 2.4 µM |
| 32 (SEQ ID NO: 19) | 32% at x 2.4 µM |

Example 8

The Human Prodomains of ADAM9 Inhibited Cellular Shedding Events In Vitro

Figure 9A:
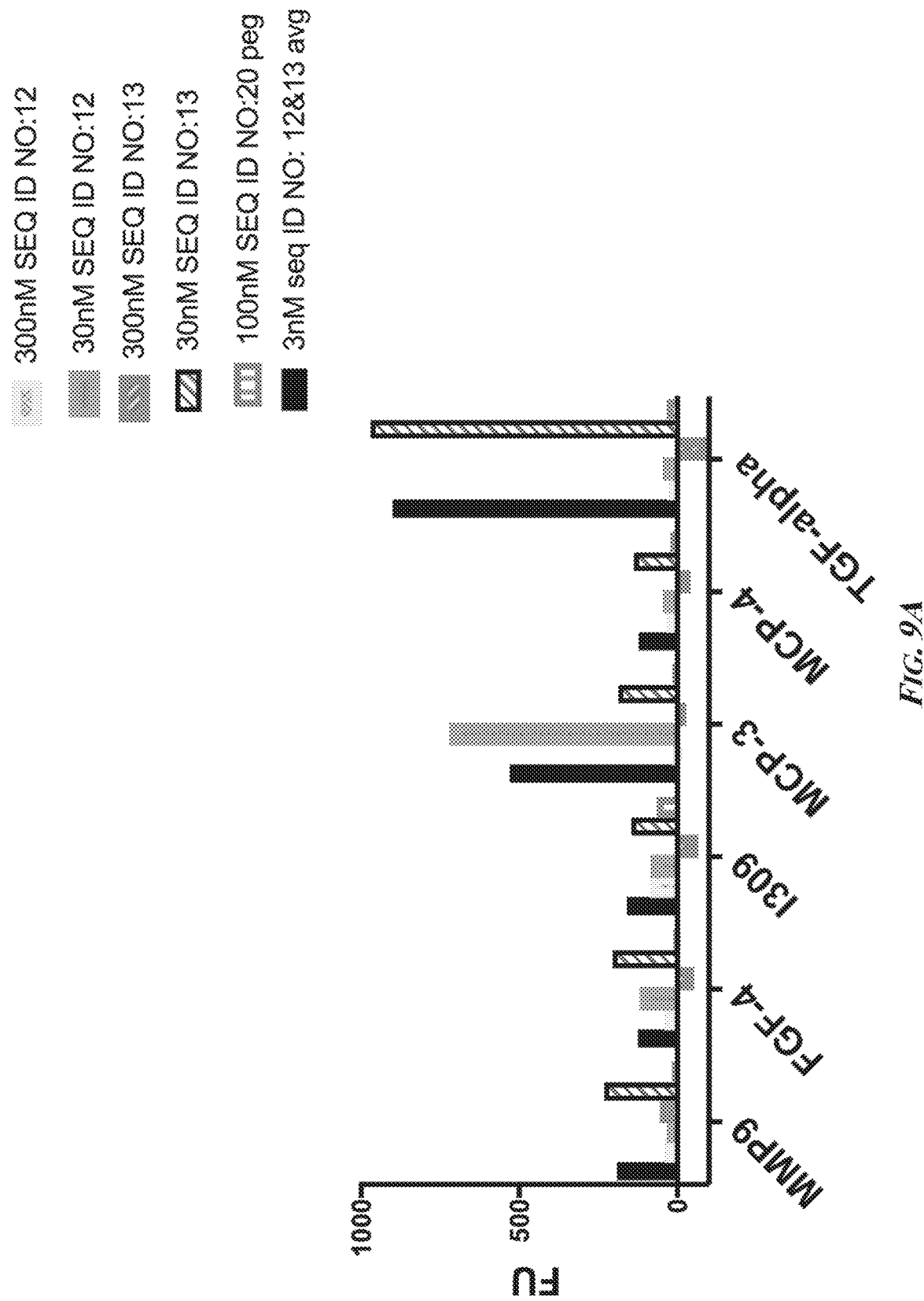
FIGS. 9A and 9B are bar graphs showing the results of experiments with respect to the ability of human ADAM9 prodomain peptides to inhibit shedding of various known ADAM9 substrates (MMP9, FGF-4, 1309, MCP-3, MCP-4, and TGFα) in vitro (FIG. 9A) as measured by fluorescence units (FU), and with respect to the ability to inhibit VEGFR2 activity (FIG. 9B). Tested were the furin mutant SEQ ID NO: 12 and SEQ ID NO: 13 (no furin mutation) at 30 nM and 300 nM. In addition, C-terminal pegylated SEQ ID NO: 20 was also tested at 100 nM. For each substrate there are six (6) bars in FIG. 9A, which from left to right are 3 nM pooled SEQ ID NOs: 12 and 13 averaged (representing no inhibition), 300 nM furin mutant SEQ ID NO: 12, 30 nM furin mutant SEQ ID NO: 12), 300 nM SEQ ID NO: 13 ((no furin mutation), 30 nM SEQ ID NO: 13 (no furin mutation), and 100 nM C-terminal pegylated. SEQ ID NO: 20 (furin mutant more susceptible to cleavage than SEQ ID NO: 12 but better than SEQ ID NO: 13).
Figure 9B:
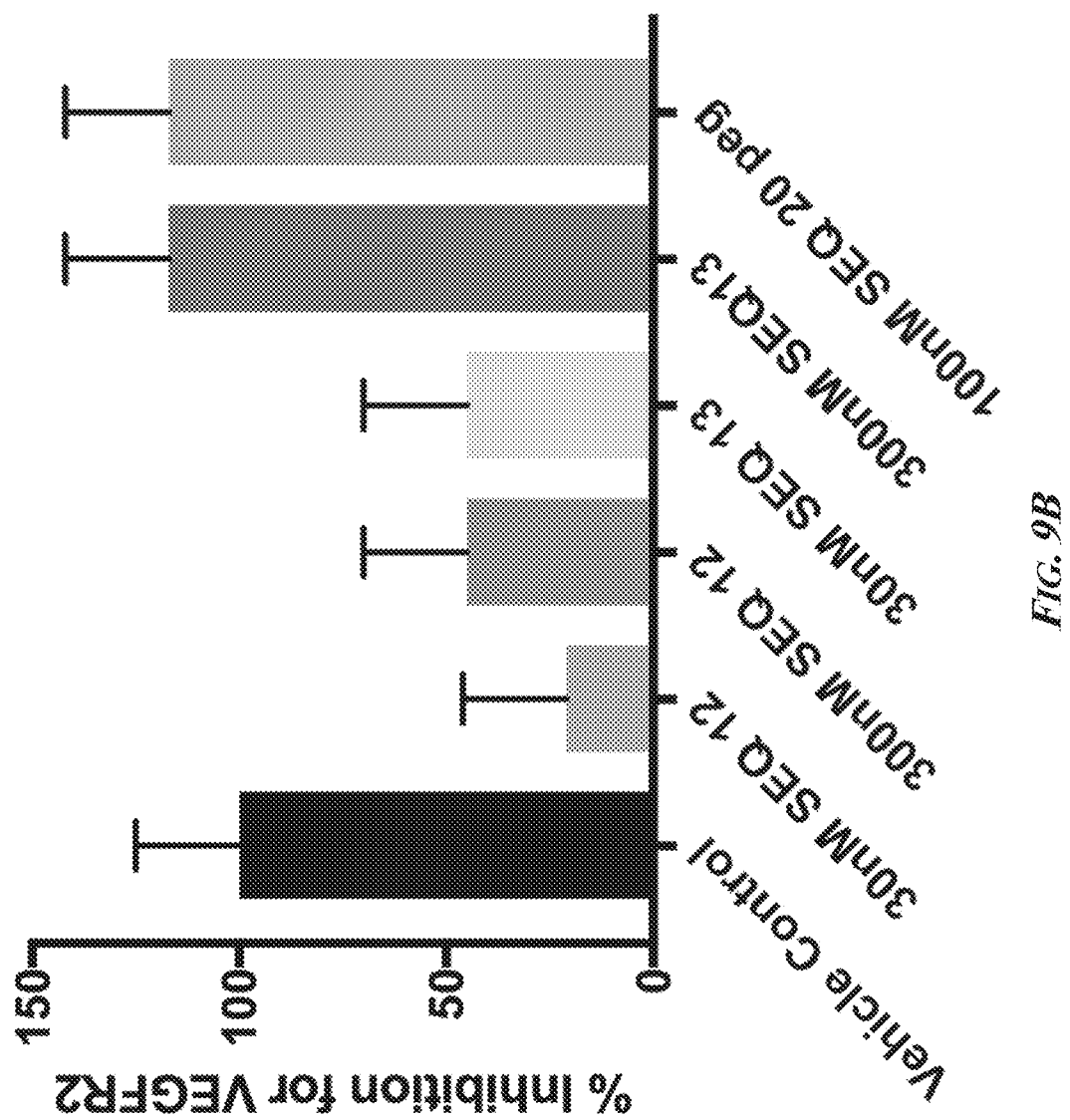

BT474 cells (20,000) were plated in a 96 well plate with growth medium and serum and prodomains or vehicle control were added from 3 nM-2.5 µM. Media was removed and incubated with an angiogenesis array from Ray Biotech (Norcross, Georgia, United States of America). Protein levels were quantified by scanning the plate for detection of fluorescent signals. FIG. 9 presents data from incubation of SEQ ID NO: 12 (furin mutant) and SEQ ID NO: 13 (no furin mutations) at 30 and 300 nM. In addition, pegylated SEQ ID NO: 20 was also tested at 100 nM.

The results showed that all prodomains were potent inhibitors of VEGFR2 and TGFα shedding (VEGFR2 and TGFα are known substrates for ADAM9) with the furin cleavage resistant mutant having better potency than the non-furin mutant. In addition, the prodomains reduced other protein levels in the media such as MMP9, FGF4, MCP-3, MCP-4, and 1309 (see FIG. 9A).

Example 9

Pharmacological Effects of Prodomain Peptides

SEQ ID NO: 10 was taken into pharmacokinetic studies in mice. Briefly, mice (3-6/group) received a single intraperitoneal (i.p.) or intransal dose or vehicle control. For i.p. injections, blood samples were taken via cardiac puncture from the two groups, respectively, or bronchial lavage fluid was collected post-treatment after intranasal dosing. Sera or bronchial lavage fluid was prepared and stored at −80° C. Proteins in the sera or bronchial lavage fluid that were increased or reduced by prodomain treatment were quantified. Sera or bronchial lavage fluid concentrations of ADAM9 prodomain peptides was also determined indirectly using a bioassay based on the inhibitory potency of the fluid against ADAM9 enzyme activity. 5-50 µl of fluid is incubated with 45 µl of 30 µM substrate, PEPDAB064 (BioZyme Inc.) containing protease inhibitors, pepstatin, AEBSF, bestatin, and E-64 (trans-Epoxysuccinyl-L-leucylamido (4-guanidino) butane; CAS Number 66701-25-5; Sigma-Aldrich), and spiked with 10 µl of ADAM9 prodomains at varying concentrations and ADAM9 was added to start the reaction. The percent ADAM9 inhibition was determined in order to prepare a standard curve by using ADAM9 prodomain of known concentration into sera. Then 5-samples were taken and added to 55 of substrate solution above and diluting it 1:6 with the buffer that the prodomains are dissolved in (20 mM Tris buffer pH 8, 40 mM NaCl, and 10% glycerol). The percent inhibition was determined relative fluid taken from a control group of mice that are injected with a vehicle control.

The prodomain concentration in sera after 48 hours was about 9.4±1.9 µM when administered at 6 mg/kg. To determine SEQ ID NO: 10 had a biological effect in vivo, Raybiotech arrays (Norcross, Georgia, United States of America) were used to assess levels of different factors in the sera by comparing vehicle control vs treated mice. Table 6 lists some of the factors up- or down-regulated by SEQ ID NO: 10 administration.

TABLE 6

Factors in Sera Reduced or Increased by SEQ ID NO: 10 treatment

| Factor | % Inhibited or Activated | SEM |
|---|---|---|
| HGF | 54 | 25 |
| Fcg RIIB | 44 | 1 |
| ALK-1 | 100 | 57 |
| HAI-1 | 43 | 6 |
| VEGFR3 | 100 | 45 |
| I-TAC | 55 | 27 |
| Fractalkine | 74 | 56 |
| Galectin-1 | −36 | −5 |
| CD40 | −57 | −18 |
| Axl | −22 | −2 |

Example 10

Furin and Meprin Cleavage Resistant Mutants Had Good Pharmacokinetic Properties

Pegylated SEQ ID NOs: 21, 22, 23, and non-pegylated. SEQ ID NOs: 12 and SEQ ID NO: 14 were injected i.p. into 2-3 Balb/C mice along with vehicle control (20 mM Tris pH8, 40 mM NaCl, and 10% glycerol). After 72 hours, blood was collected via cardiac puncture and sera were prepared. Prodomain levels were measured by first preparing standard curves where varying amounts of each prodomain were incubated in a black His tag coated plate (Fisher Scientific).

To prepare standard curves, 75 µl blocking buffer containing protease inhibitor cocktail were spiked with control mouse sera (no treatment) and prodomains. After 30 minutes the solutions were aspirated and wells were washed twice with wash buffer followed by assay buffer (20 mM Tris pH 8, 0.001% BRIJ® 35 brand non-ionic detergent, pH 8). Then, 40-50 µl of assay buffer containing 15 µM PEP-DAB064 (BioZyme Inc.) was added to each well and mouse ADAM9 (R & D Systems) was added to start the reaction. The percent Inhibition of ADAM9 was plotted vs. prodomain concentration to obtain a standard curve.

To calculate the levels of prodomain from the PK experiment, sera collected at 72 hours was added to 75 µl of blocking buffer as described above and incubated for 30 minutes. After washing, assay buffer with PEPDAB064 and ADAM9 was added, and the percent inhibition was quantified once more. Sera levels were calculated by fitting the percent inhibition to the standard curves generated for each prodomain.

Figure 10:
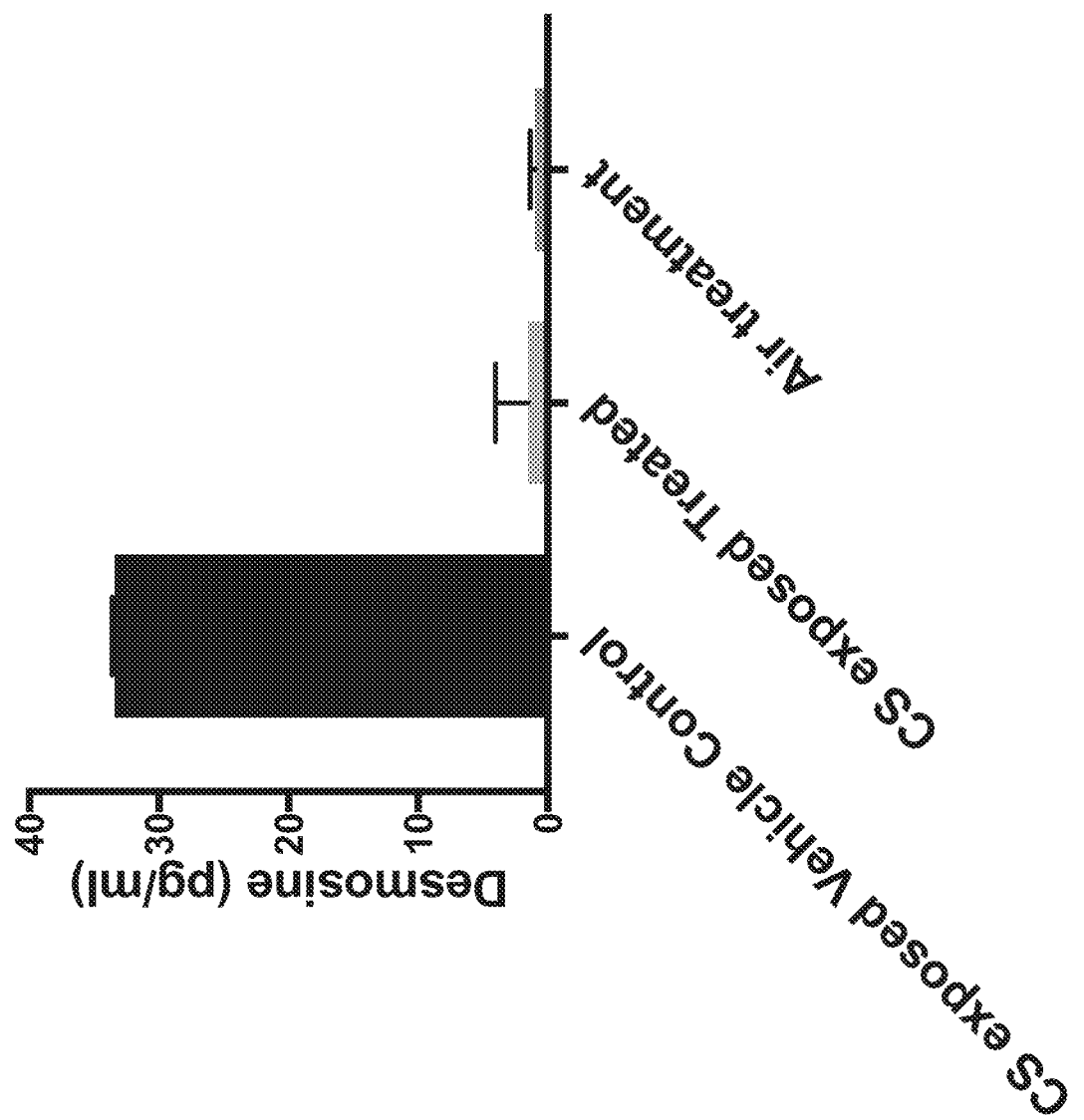
FIG. 10 is a bar graph showing the results of experiments with respect to the ability of human ADAM9 prodomain peptides to inhibit elastin degradation in an acute cigarette smoking (CS) model as measured by ELISA for desmosine. Error bars are +standard error of the mean (S.E.M.). SEQ ID NO: 10 or vehicle control was given for two weeks intranasally. Elastin degradation was completely blocked by SEQ ID NO: 10 administration.

The results are presented in FIG. 10 for the PK experiment where sera levels were measured at 72 hours. Pegylated SEQ ID NO: 22 was the most stable construct, and was also the least susceptible construct to be degraded by the combination of meprin and furin. Other pegylated constructs (SEQ NO: 21 and SEQ ID NO: 23) had sera levels that were worse than for SEQ ID NO: 12 and pegylated SEQ ID NO: 22. Pegylated SEQ ID NO: 22 was also more stable than the non-pegy hated equivalent SEQ ID NO: 12, which was not stable to meprin cleavage. Note that SEQ ID NO: 14, which did not have the most stable furin cleavage site, had a poorer PK value even though it had a more stable meprin site.

Example 11

Acute Cigarette Smoking Model

C57BL/6 strain T mice (aged 8-12 weeks) were exposed to air or mixed mainstream and side-stream cigarette smoke (CS) for 2 hours/day on 6 days/week in Teague TE 10z chambers (Teague Enterprises, Woodland, California, United States of America). After two weeks, mice given CS were either given every other day 30 µl of vehicle control (20 mM Tris pH 8, 40 mM NaCl and 10% glycerol) or SEQ ID NO: 10 (30 µl at 0.75 mg/Kg) via intra nasal administration. After two more weeks of additional CS exposure, bronchoalveolar lavage (BAL) was obtained and elastin degradation (ELISA for desmosine; Cusabio Technology LLC, Houston, Texas, United States of America) as well as pro- and anti-inflammatory mediator arrays (RayBiotech).

Figure 11:
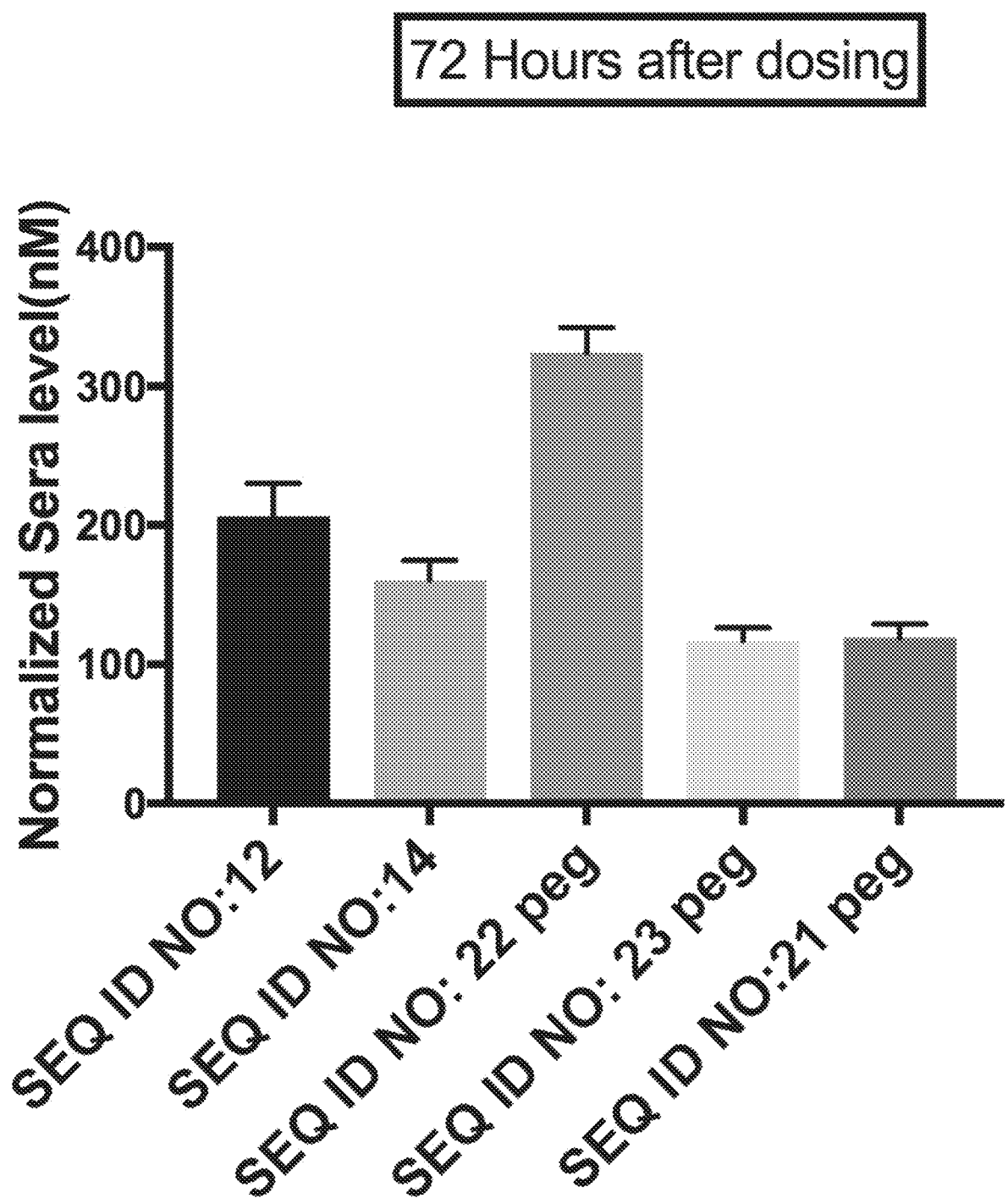
FIG. 11 is a bar graph of prodomain levels in sera 72 hours after prodomains or vehicle control were injected i.p. into mice and measured as described. Data represents the means from 2-3 sera. Error bars indicate the SEM for each sample, peg indicates that the prodomain peptide was pegylated. The N-terminal pegylated SEQ ID NO: 22, which was the most stable to meprin and flurin cleavage, had the highest sera levels after 72 hours. The other pegylated prodomains had lower sera levels than the non-pegylated SEQ ID NO: 12, indicating that N-terminal pegylation was best. SEQ ID NO: 14, which was more stable to meprin but had a furin site that was not completely resistant to cleavage, had lower sera levels than SEQ ID NO: 12, which had no meprin mutation, indicating that besides meprin stability, furin stability enhanced pharmacokinetic properties.
Figure 12:
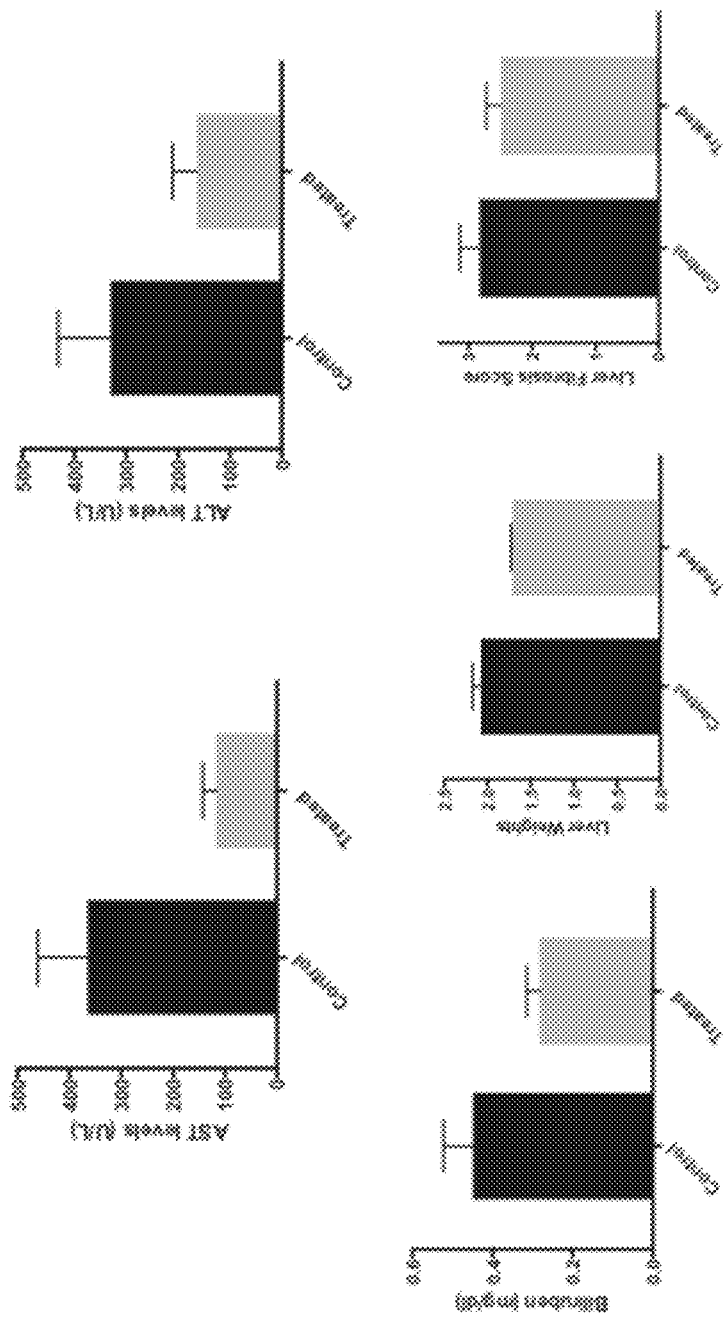
FIG. 12 is a series of graphs showing levels of various liver enzyme function markers in an acute liver injury model in mice in either treated (Treated) or not treated (Vehicle) with the furin mutant SEQ ID NO: 12. The upper left panel shows aspartate aminotransferase (AST) levels, the upper right panel shows alanine aminotransferase (ALT) levels, the lower left panel shows bilirubin levels, the lower center bar graph shows liver weights, and the bar graph in the lower right panel shows a liver fibrosis score measured by determining the amount of collagen deposition. Liver enzyme levels, bilirubin levels, liver weights, and fibrosis scores were all reduced by SEQ ID NO: 12 treatment relative to vehicle control. Error bars are +standard error of the mean (S.E.M.).

Table 7 presents a list of factors that were reduced in BAL of CS exposed mice when comparing control vs. treated groups. Factors that were increased included IL1-RA and IL-10, which are both anti-inflammatory mediators. In CS exposed mice, elastin degradation as measured by desmosine levels are quite high. BAL desmosine levels are shown in FIG. 11. Administration of SEQ ID NO: 10 completely prevented the degradation of elastin, SEQ ID NO: 10 levels were also determined 30 minutes after administration using a bio assay as described above in EXAMPLE 8. BAL levels when administered at 0.75 mg/kg were about 10 µM.

TABLE 7

Factors Decreased in BAL from treated mice relative to controls

| Factor | % Decrease | Function |
|---|---|---|
| Pro MMP9 | 78 | Protease that degrades matrix proteins lung tissue |
| MMP2 | 79 | Degradative protease |
| MMP3 | 89 | Degradative protease |
| MMP10 | 44 | Degradative protease |
| Lymphotactin | 70 | Chemokine for T cells |
| IL-15 | 100 | Induces proliferation of natural killer cells |
| LIX | 100 | Chemokine for neutrophil recruitment |
| MIP-1 alpha | 100 | Macrophage chemokine that produces inflammation |
| Lungkine | 70 | Pro-inflammatory chemokine produced by lungs |
| Tarc | 92 | Chemokine promoting inflammation |
| PF4 | 95 | Wound repair and inflammation |
| VCAM-1 | 63 | Promotes adhesion of inflammatory cells |
| Maraspin | 100 | Serine protease produced by lungs involved in inflammation |

TABLE 7-continued

Factors Decreased in BAL from treated mice relative to controls

| Factor | % Decrease | Function |
|---|---|---|
| TWEAK | 100 | Inflammation and death biomarker |
| TRAIL | 87 | Cell death promoter |
| TGF beta | 67 | Promotes fibrosis |
| TWEAK Receptor | 65 | Inflammation and cell death mediator |
| FAS Ligand | 84 | Promotes cell death |

Example 12

Acute Liver Injury and Fibrosis Model 18 male, 8-week-old BALB/c mice were randomized into study groups based on body weight. Treatment with $CCl_4$ solution was initiated in all mice and continued for a duration of 2 weeks. Therapeutic treatments coincided with $CCl_4$ initiation. Compound administration and CCl4 solution were at least 4 hours apart) for this two week prophylactic dosing study, as outlined in Table 8.

TABLE 8

Study Groups and Treatments

| Study Group Number | Mice per group | Fibrosis Induction | Test Article (TA) |
|---|---|---|---|
| 1 | 6 | 20% $CCl_4$, BIW for 0-2 weeks | Vehicle, i.p., EOD for 7 doses, 0-2 weeks |
| 2 | 6 | 20% $CCl_4$, BIW for 0-2 weeks | SEQ ID NO: 12, i.p., EOD for 7 doses, 0-2 weeks |
| 3 | 6 | 20% $CCl_4$, BIW for 0-2 weeks | SEQ ID NO: 12, i.p., EOD for 7 doses, 0-2 weeks |

BIW: biweekly;
EOD: every other day

At the end of the study, approximately 400 µl whole blood was collected into serum separator tubes for ALT, AST, ALP, and bilirubin analyses. Following the terminal blood collection each mouse had livers isolated, weighed, and cut into 4 sections as follows: a central section of the left lobe was formalin fixed (FFPE) for histology analysis; and three (3) smaller, separate sections, one from the is remaining left lobe and two from the right lobe (~50-100 mg each) was snap frozen and stored at −0° C.

Histology Analysis: Liver fibrosis scoring of the H&E/PSR stained liver sections from FFPE livers harvested at termination was provided by Board Certified Veterinary Pathologist (DVM). Scoring included fibrosis and other pertinent observations such as necrosis and inflammation.

Figure 13:
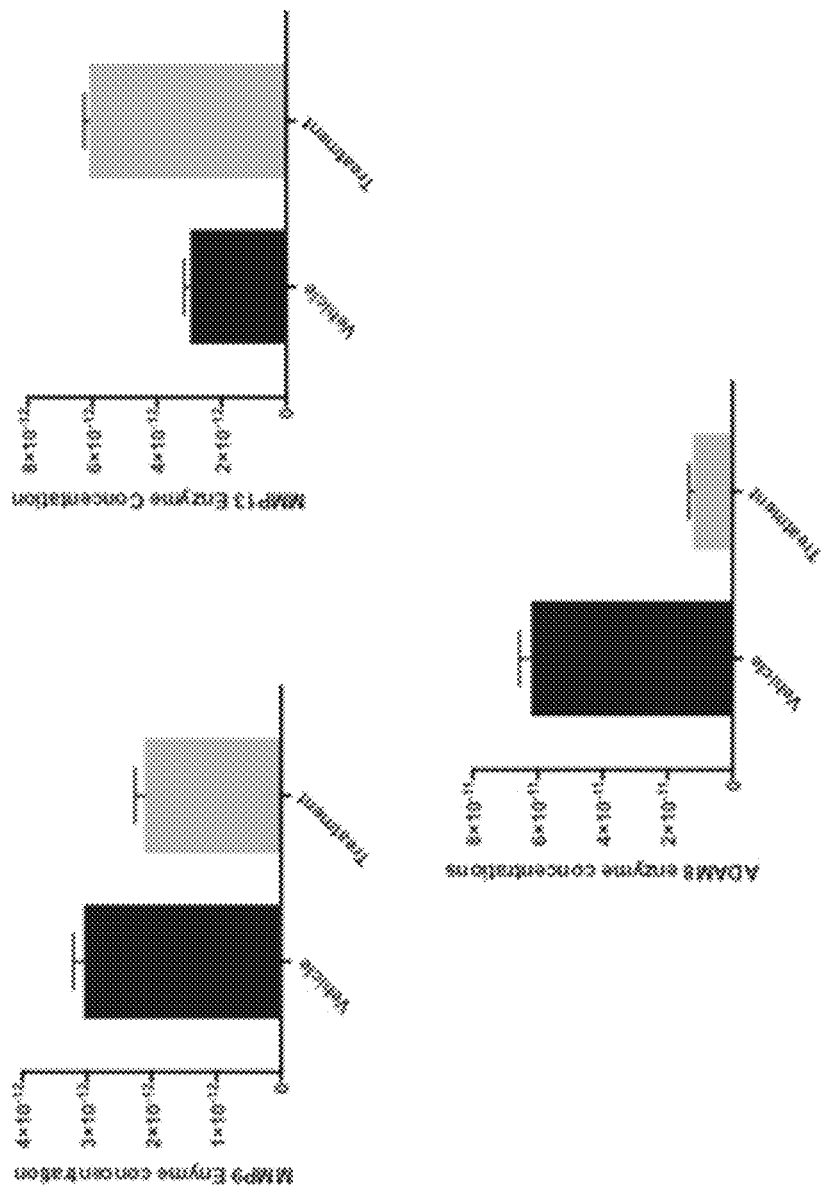
FIG. 13 is a series of graphs showing the enzyme concentrations of MMP9 (upper left panel), MMP13 (upper right panel), and ADAM8 (lower panel) in liver homogenates of mice from the acute liver injury model described above for FIG. 12. The data showed that SEQ ID NO: 12 treatment reduced the levels of MMP9 and ADAM8 in liver samples, whereas MMP13 levels were increased. Error bars are +standard error of the mean (S.E.M.).

FIG. 11 presents the results from the study. Compared to the control group, the liver weights were reduced indicating a beneficial effect with compound treatment. AST and ALT levels were also reduced in the treated groups as well as bilirubin levels. Finally, there was a decrease in the liver fibrosis score as well. Liver samples were taken and lysates were made and MMP and ADAM family member enzyme levels were quantified using Proteolytic Activity Matrix Analysis (PrAMA; Miller et al., 2011) with five (5) different fluorescent substrates. With this analysis, MMP9 and ADAM9 levels were reduced in the treated group whereas MMP13 levels were increased (see FIG. 13).

Example 13

In Vivo Studies: Tumor Xenograft Model

To determine whether the ADAM9 prodomain had therapeutic potential for tumor growth inhibition in vivo, efficacy studies are performed using derived xenograft tumor models in athymic mice. Briefly, cells, $1 \times 10^7$ cells, are implanted s.c. into the flanks of 6-week-old female athymic mice. Tumor sizes in two dimensions are measured with calipers, and volumes are calculated. The treatments start when the tumor size has reached approximately 200 $mm^3$. Vehicle control and ADAM9 prodomain peptide alone at two doses are given as determined from pharmacokinetic data. Each treatment group (n=6-12 per group) is monitored for up to 7-8 weeks. Body weights and tumors are measured twice weekly, and tumor growth and regression rates are determined. Animals are euthanatized at the end of the experiment and the liver, heart, visceral fat, kidneys, and brain are retained and examined for tissue damage and toxicity.

The ADAM9 prodomain peptide is used in a suitable dose in combination with other cancer agents in the xenograft tumor model. Cancer agents, alone or in combination with ADAM9 prodomain peptides, are administered and the experiment is performed as described above.

Example 14

Inhibition of Neo-Vascularization with Prodomain Peptides

Choroidal neovascularization (CNV) occurs in is a major cause of severe visual loss, mostly in patients with age-related macular degeneration. A murine model of CNV is employed to test for the abilities of ADAM9 prodomain peptides to inhibit neo-vascularization. Thirteen male adult C57BL/6J mice (13 per group, 2 groups) are anesthetized by intraperitoneal injection of 0.3 ml of ketamine hydrochloride diluted 1:10 with sterile water. The pupils are dilated with 1% tropicamide, and three burns of krypton laser photocoagulation (50-µm spot size; 0.05 seconds duration; 350 to 400 mW) are delivered to each retina using a slit lamp delivery system and a cover glass as a contact lens to detect the retinas. The production of a bubble at the time of laser indicates rupture of Bruch's membrane.

Burns in which a bubble is produced are included in the study. Burns are performed in the 9, 12, and 3 o'clock positions of the posterior pole of the retina so that each burn can be identified postmortem and compared with respect to fluorescein angiographic and histopathological characteristics. Prodomain peptides or vehicle control (20 mM Tris pH8, 10% glycerol) are given i.p. from 1-4 weeks during which time fluorescein angiograms are done in some mice by taking serial fundus photographs with a TRC-50FT camera (Topcon, Paramus, New Jersey, United States of America) after i.p. injection of 0.3 ml of 1% fluorescein sodium (Alcon, Fort Worth, Texas, United States of America). At various times after laser treatment, mice are sacrificed and their eyes enucleated and fixed in 2% paraformaldehyde/2% glutaraldehyde in 0.1 M cacodylate buffer (pH 7.4) for 24 hours at 4° C. or in the same buffer containing only 4% paraformaldehyde. To get an estimate of the incidence of CNV at various time points after laser treatment, burns are selected randomly over the treatment period. Lesions are examined by light microscopy and some lesions are also analyzed by transmission electron microscopy.

Example 15

Inhibition of Wound Healing with Prodomain Peptides

C57/B16 (8-10 weeks old; 8 per group; 2 groups) mice are anesthetized with a single i.p. injection of ketamine/xylazine. The hair on the back is shaved and the skin wiped with 70% ethanol. Two full-thickness excisional wounds (4 mm diameter) are created on the back of each animal by excising the skin and panniculus carnosus as previously described. The wounds are allowed to dry to form a scab. Animals are administered via IP injection or with a topical application of vehicle control (20 mM Tris pH 8, 10% glycerol) or prodomain every 1-3 days for two weeks. Mice are sacrificed at different time points after wounding and the complete wounds, including the epithelial margins, are isolated. Wounds are bisected in caudocranial direction and the tissue embedded in O.C.T. Compound (Tissue Tek, Vogel, Giessen, Germany), and used for immunohistochemistry Histological analyses are performed on serial sections from the central portion of the wound. Cryosections (5 µm) of the wounds are stained with hematoxylitin and eosin (H&E; Shandon, Frankfurt, Germany), documented, and measured using a Leica microscope (DMLB, Wetzlar, Germany).

Example 16

Treatment of Alzheimer's Disease with Prodomain Peptides

Eight week old PDAPP, $APP_{[V717I]}$ or Tg2576 mice (10 per group, 2 groups) are given vehicle control or prodomain intranasally or intracecally every 1-7 days over the course of 3-7 months. Brains are dissected and immunohistochemistry and quantitative plaque analyses are performed. Briefly, one hemisphere is fixed in 4% paraformaldehyde in PBS for 24 hours and the frontal quarter is embedded in paraffin. Amyloid plaques are identified with the antibody 6E/3D which detects Aβ 40 and 42. The occipital paraformaldehyde-fixed quarter is used for quantitation of the amyloid plaque load in the subiculum using thioflavine S staining of vibratome-cut sections (40 µm thick). Fluorescence images are acquired on an inverted microscope (Leica DMR; Leica Microsystems, Bensheim, Germany) equipped with a 3 CCD digital camera (Sony DXC-9100P; Sony Corp., Cologne, Germany), and analyzed with dedicated software (Leica QWin system). The total surface area of amyloid deposits is measured and expressed as a percentage of the total surface of the subiculum.

For electrophysiology, hippocampal slices are prepared from anesthetized mice using a vibratome. Slices are then incubated in a submersion chamber with warm, oxygenated, artificial cerebrospinal fluid. Schaffer collateral pathway is then stimulated using a bipolar tungsten microelectrode. Mice are also subjected to a Morris water maze. Nine-ten mice per group are trained in the maize using a Morris water-maze task with a submerged platform. Trials, four per day, for 4 days were preformed with a maximum length of 90 seconds with intertrial intervals of 90 seconds. The mice are allowed to stay on the platform for 30 seconds initially. On the fifth day, a trial of 60 seconds without the platform is done. The time to reach the location of the supposed platform is measured and presented as latency. In addition, the number of annulus crossings are calculated.

REFERENCES

All references listed below, as well as all references cited in the instant disclosure, including but not limited to all patents, patent applications and publications thereof, scientific journal articles, and database entries (e.g., GEN-BANK® biosequence database entries and all annotations available therein) are incorporated herein by reference in their entireties to the extent that they supplement, explain, provide a background for, or teach methodology, techniques, and/or compositions employed herein.

Banerjee et al. (2011) American Journal of Physiology-Gastrointestinal and Liver Physiology 300:G273-282.

Bergin et al. (2008) Journal of Biological Chemistry 283: 31736-31744.

Deuss et al. (2008) Current Alzheimer Research 5:187-201.

Edwards et al. (2008) Molecular Aspects of Medicine 29(5): 258-289.

Guaiquil et al. (2009) Molecular and Cellular Biology 29(10):2694-2703.

Jefferson et al. (2013) Cellular and Molecular Life Sciences 70:309-333.

Kyte & Doolittle (1982) Journal of Molecular Biology 157:105-132.

Ludwig et al. (2005) Combinatorial Chemistry & High Throughput Screening 8(2):161-171.

Maretzky et al. (2017) The Biochemical Journal 474(9): 1467-1479.

Mauch et al. (2014) The Journal of Investigative Dermatology 130:2120-2130.

Miller et al. (2011) Integr Biol (Carob) 3:422-438.

Moss et al. (2008) Nature Clinical Practice Rheumatology 4(6):300-309.

Moss et al. (2011) Journal of Biological Chemistry 286(47): 40443-40451.

Pruessmeyer & Ludwig (2009) Seminars in Cell & Developmental Biology 20(2):164-174.

Roychaudhuri et al. (2014) Journal of Immunology 193: 2469-2482.

Sahin et al. (2004) The Journal of Cell Biology 164(5):769-779.

Schutte et al. (2014) Proceedings of the National Academy of Sciences of the United States of America 111:12396-12401.

Vazeine et al. (2011) Role of meprins to protect ilcal mucosa of Crohn's disease patients from colonization by adherent-invasive E. coli, PLoS One 6:e21199.

Wang et al. (2018) A Disintegrin and A Metalloproteinase-9 (ADAM9): A Novel Proteinase Culprit with Multifarious Contributions to COPD. American Journal of Respiratory and Critical Care Medicine. June 4. doi: 10.1164/rccm.201711-23000C. [Epub ahead of print]

Wong et al. (2015) Journal of Biological Chemistry 290(19): 12135-12146.

Wong et al. (2016) Scientific Reports 6:35598.

Thou et al. (2006) Cancer Cell 10(1):39-50.

It will be understood that various details of the presently disclosed subject matter can be changed without departing from the scope of the presently disclosed subject matter. Furthermore, the foregoing description is for the purpose of illustration only, and not for the purpose of limitation.

SEQUENCE LISTING (430947 sequences)

SEQ ID NO: 1 - protein, 819 aa, HOMO SAPIENS
MGSGARFPSGTLRVRWLLLLGLVGPVLGAARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDEEEEPPSMTQLLRRRRAVLPQTRYVELFIVVDKERYDMMGRNQTAVREEMILLANYLDSMYIMLNIRIVLVGLEIWTNGNLINIVGGAGDVLGNFVQWREKFLITRRRHDSAQLVLKKGFGGTAGMAFVGTVCSRSHAGGINVFGQITVETFASIVAHELGHNLGMNHDDGRDCSCGAKSCIMNSGASGSRNFSSCSAEDFEKLTLNKGGNCLLNIPKPDEAYSAPSCGNKLVDAGEECDCGTPKECELDPCCEGSTCKLKSFAECAYGDCCKDCRFLPGGTLCRGKTSECDVPEYCNGSSQFCQPDVFIQNGYPCQNNKAYCYNGMCQYYDAQCQVIFGSKAKAAPKDCFIEVNSKGDRFGNCGFSGNEYKKCATGNALCGKLQCENVQEIPVFGIVPAIIQTPSRGTKCWGVDFQLGSDVPDPGMVNEGTKCGAGKICRNFQCVDASVLNYDCDVQKKCHGHGVCNSNKNCHCENGWAPPNCETKGYGGSVDSGPTYNEMNTALRDGLLVFFFLIVPLIVCAIFIFIKRDQLWRSYFRKKRSQTYESDGKNQANPSRQPGSVPRHVSPVTPPREVPIYANRFAVPTYAAKQPQQFPSRPPPPQPKVSSQGNLIPARPAPAPPLYSSLT

SEQ ID NO: 2 - protein, 174 aa, HOMO SAPIENS
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDEEEEPPSMTQLLRR

SEQ ID NO: 3 - protein, 174 aa, ARTIFICIAL SEQUENCE
  Artificial ADAM9 prodomain peptide
  misc_feature (6)..(7): Xaa can be any naturally occurring amino acid
  misc_feature (24)..(24): Xaa can be any naturally occurring amino acid
  misc_feature (26)..(27): Xaa can be any naturally occurring amino acid
  misc_feature (61)..(62): Xaa can be any naturally occurring amino acid
  misc_feature (85)..(85): Xaa can be any naturally occurring amino acid or if Cys contains a sulfhydryl modification
  misc_feature (104)..(104): Xaa can be any naturally occurring amino acid or if Cys contains a sulfhydryl modification
  misc_feature (137)..(138): Xaa can be any naturally occurring amino acid
  misc_feature (146)..(146): Xaa can be any naturally occurring amino acid or if Cys contains a sulfhydryl modification
  misc_feature (160)..(164): Xaa can be any naturally occurring amino acid
ARPGFXXTSHLSSYEIITPWRLTXEXXEAPRPYSKQVSYVIQAEGKEHIIHLERNKDLLPXXFVVYTYNKEGTLITDHPNIQNHXHYRGYVEGVHNSSIALSDXFGLRGLLHLENASYGIEPLQNSSHFEHIIYRMXXVYKEPLKXGVSNKDIEKETAKXXXXXPPSMTQLLRR

SEQ ID NO: 4 - protein, 175 aa, ARTIFICIAL SEQUENCE
  Artificial ADAM9 prodomain peptide
  misc_feature (7)..(8): Xaa can be any naturally occurring amino acid
  misc_feature (25)..(25): Xaa can be any naturally occurring amino acid
  misc_feature (27)..(28): Xaa can be any naturally occurring amino acid
  misc_feature (62)..(63): Xaa can be any naturally occurring amino acid
  misc_feature (86)..(86): Xaa can be any naturally occurring amino acid
  misc_feature (105)..(105): Xaa can be any naturally occurring amino acid
  misc_feature (138)..(139): Xaa can be any naturally occurring amino acid
  misc_feature (147)..(147): Xaa can be any naturally occurring amino acid
  misc_feature (161)..(165): Xaa can be any naturally occurring amino acid
CARPGFXXTSHLSSYEIITPWRLTXEXXEAPRPYSKQVSYVIQAEGKEHIIHLERNKDLLPXXFVVYTYNKEGTLITDHPNIQNHXHYRGYVEGVHNSSIALSDXFGLRGLLHLENASYGIEPLQNSSHFEHIIYRMXXVYKEPLKXGVSNKDIEKETAKXXXXXPPSMTQLLRR

SEQ ID NO: 5 - protein, 175 aa, ARTIFICIAL SEQUENCE
  Artificial ADAM9 prodomain peptide
  misc_feature (6)..(7): Xaa can be any naturally occurring amino acid
  misc_feature (24)..(24): Xaa can be any naturally occurring amino acid
  misc_feature (26)..(27): Xaa can be any naturally occurring amino acid
  misc_feature (61)..(62): Xaa can be any naturally occurring amino acid
  misc_feature (85)..(85): Xaa can be any naturally occurring amino acid or if Cys contains a sulfhydryl modification
  misc_feature (104)..(104): Xaa can be any naturally occurring amino acid or if Cys contains a sulfhydryl modification
  misc_feature (137)..(138): Xaa can be any naturally occurring amino acid
  misc_feature (146)..(146): Xaa can be any naturally occurring amino acid or if Cys contains a sulfhydryl modification
  misc_feature (160)..(164): Xaa can be any naturally occurring amino acid
ARPGFXXTSHLSSYEIITPWRLTXEXXEAPRPYSKQVSYVIQAEGKEHIIHLERNKDLLPXXFVVYTYNKEGTLITDHPNIQNHXHYRGYVEGVHNSSIALSDXFGLRGLLHLENASYGIEPLQNSSHFEHIIYRMXXVYKEPLKXGVSNKDIEKETAKXXXXXPPSMTQLLRRC

SEQ ID NO: 6 - protein, 174 aa, ARTIFICIAL SEQUENCE
  Artificial ADAM9 prodomain peptide
  misc_feature (24)..(24): Xaa can be any naturally occurring amino acid
  misc_feature (26)..(27): Xaa can be any naturally occurring amino acid
ARPGFQQTSHLSSYEIITPWRLTXEXXEAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDEEEEPPSMTQLLRR

SEQ ID NO: 7 - protein, 174 aa, ARTIFICIAL SEQUENCE
  Artificial ADAM9 prodomain peptide
  misc_feature (24)..(24): Xaa can be any naturally occurring amino acid
  misc_feature (26)..(27): Xaa can be any naturally occurring amino acid
ARPGFQQTSHLSSYEIITPWRLTXEXXEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDEEEEPPSMTQLLRR

SEQ ID NO: 8 - protein, 174 aa, ARTIFICIAL SEQUENCE
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDEEEEPPSMTQLLRR

SEQ ID NO: 9 - protein, 174 aa, ARTIFICIAL SEQUENCE
  Artificial ADAM9 prodomain peptide
ARPGFQQTSHLSSYEIITPWRLTREAREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDEEEEPPSMTQLLRR

SEQ ID NO: 10 - protein, 174 aa, ARTIFICIAL SEQUENCE
  Artificial ADAM9 prodomain peptide
ARPGFQQTSHLSSYEIITPWRLTREAREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDEEEEPPSMTQLLRR

SEQ ID NO: 11 - protein, 174 aa, ARTIFICIAL SEQUENCE
  Artificial ADAM9 prodomain peptide
ARPGFQQTSHLSSYEIITPWRLTAERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDEEEEPPSMTQLLRR

SEQ ID NO: 12 - protein, 174 aa, ARTIFICIAL SEQUENCE
  Artificial ADAM9 prodomain peptide
ARPGFQQTSHLSSYEIITPWRLTRERAEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDEEEEPPSMTQLLRR

SEQ ID NO: 13 - protein, 174 aa, ARTIFICIAL SEQUENCE
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDEEEEPPSMTQLLRR

SEQ ID NO: 14 - protein, 174 aa, ARTIFICIAL SEQUENCE
  Artificial ADAM9 prodomain peptide
ARPGFQQTSHLSSYEIITPWRLTREAREAPRPYSKQVSYVIQAEGKEHIIHLERNKDLLPEAFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDEEEEPPSMTQLLRR

SEQ ID NO: 15 - protein, 174 aa, ARTIFICIAL SEQUENCE
  Artificial ADAM9 prodomain peptide
ARPGFQQTSHLSSYEIITPWRLTRERGEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDEEEEPPSMTQLLRR

SEQ ID NO: 16 - protein, 174 aa, ARTIFICIAL SEQUENCE
  Artificial ADAM9 prodomain peptide
ARPGFQQTSHLSSYEIITPWRLTRERSEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDEEEEPPSMTQLLRR

SEQ ID NO: 17 - protein, 168 aa, ARTIFICIAL SEQUENCE
  Artificial ADAM9 prodomain peptide
QTSHLSSYEIITPWRLTRERAEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDEEEEPPSMTQLLRR

SEQ ID NO: 18 - protein, 174 aa, ARTIFICIAL SEQUENCE
  Artificial ADAM9 prodomain peptide
ARPGFQQTSHLSSYEIITPWRLTRERAEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDSVYKEPLKSGVSNKDIEKETAKDEEEEPPSMTQLLRR

SEQ ID NO: 19 - protein, 174 aa, ARTIFICIAL SEQUENCE
  Artificial ADAM9 prodomain peptide
ARPGFQQTSHLSSYEIITPWRLTRERAEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDNENEPPSMTQLLRR

SEQ ID NO: 20 - protein, 179 aa, ARTIFICIAL SEQUENCE
  Artificial ADAM9 prodomain peptide
ARPGFQQTSHLSSYEIITPWRLTREAREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDEEEEPPSMTQLLRRGSGSC

SEQ ID NO: 21 - protein, 174 aa, ARTIFICIAL SEQUENCE
  Artificial ADAM9 prodomain peptide
ARPGFQQTSHLSSYEIITPWRLTRERAEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDEEEEPPSMTQLLRR

SEQ ID NO: 22 - protein, 179 aa, ARTIFICIAL SEQUENCE
  Artificial ADAM9 prodomain peptide
GSCGSARPGFQQTSHLSSYEIITPWRLTRERAEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDEEEEPPSMTQLLRR

SEQ ID NO: 23 - protein, 179 aa, ARTIFICIAL SEQUENCE
  Artificial ADAM9 prodomain peptide
ARPGFQQTSHLSSYEIITPWRLTRERAEAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDEEEEPPSMTQLLRRGSGSC

SEQ ID NO: 24 - protein, 6 aa, ARTIFICIAL SEQUENCE
  Artificial ADAM9 prodomain peptide
HHHHHH

SEQ ID NO: 25 - protein, 6 aa, HOMO SAPIENS
KDEEEE

SEQ ID NO: 26 - protein, 5 aa, ARTIFICIAL SEQUENCE
  Artificial ADAM9 prodomain peptide
GSCGS

SEQ ID NO: 27 - protein, 5 aa, ARTIFICIAL SEQUENCE
  Artificial ADAM9 prodomain peptide
GSGSC

SEQ ID NO: 28 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDGGGEPPSMTQLLRR

SEQ ID NO: 29 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDGGSEPPSMTQLLRR

SEQ ID NO: 30 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDGGAEPPSMTQLLRR

SEQ ID NO: 31 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDGSGEPPSMTQLLRR

SEQ ID NO: 32 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDGSSEPPSMTQLLRR

SEQ ID NO: 33 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDGSAEPPSMTQLLRR

SEQ ID NO: 34 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDGAGEPPSMTQLLRR

SEQ ID NO: 35 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDGASEPPSMTQLLRR

SEQ ID NO: 36 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDGAAEPPSMTQLLRR

SEQ ID NO: 37 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDSGGEPPSMTQLLRR

SEQ ID NO: 38 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDSGSEPPSMTQLLRR

SEQ ID NO: 39 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDSGAEPPSMTQLLRR

SEQ ID NO: 40 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDSSGEPPSMTQLLRR

SEQ ID NO: 41 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDSSSEPPSMTQLLRR

SEQ ID NO: 42 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDSSAEPPSMTQLLRR

SEQ ID NO: 43 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDSAGEPPSMTQLLRR

SEQ ID NO: 44 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDSASEPPSMTQLLRR

SEQ ID NO: 45 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDSAAEPPSMTQLLRR

SEQ ID NO: 46 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDAGGEPPSMTQLLRR

SEQ ID NO: 47 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDAGSEPPSMTQLLRR

SEQ ID NO: 48 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDAGAEPPSMTQLLRR

SEQ ID NO: 49 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDASGEPPSMTQLLRR

SEQ ID NO: 50 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDASSEPPSMTQLLRR

SEQ ID NO: 51 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDASAEPPSMTQLLRR

SEQ ID NO: 52 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDAAGEPPSMTQLLRR

SEQ ID NO: 53 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDAASEPPSMTQLLRR

SEQ ID NO: 54 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDAAAEPPSMTQLLRR

SEQ ID NO: 55 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDGGGEPPSMTQLLRR

SEQ ID NO: 56 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDGGSEPPSMTQLLRR

SEQ ID NO: 57 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDGGAEPPSMTQLLRR

SEQ ID NO: 58 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDGSGEPPSMTQLLRR

SEQ ID NO: 59 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDGSSEPPSMTQLLRR

SEQ ID NO: 60 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDGSAEPPSMTQLLRR

SEQ ID NO: 61 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDGAGEPPSMTQLLRR

SEQ ID NO: 62 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDGASEPPSMTQLLRR

SEQ ID NO: 63 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDGAAEPPSMTQLLRR

SEQ ID NO: 64 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDSGGEPPSMTQLLRR

SEQ ID NO: 65 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDSGSEPPSMTQLLRR

SEQ ID NO: 66 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDSGAEPPSMTQLLRR

SEQ ID NO: 67 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDSSGEPPSMTQLLRR

SEQ ID NO: 68 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDSSSEPPSMTQLLRR

SEQ ID NO: 69 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDSSAEPPSMTQLLRR

SEQ ID NO: 70 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDSAGEPPSMTQLLRR

SEQ ID NO: 71 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDSASEPPSMTQLLRR

SEQ ID NO: 72 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDSAAEPPSMTQLLRR

SEQ ID NO: 73 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDAGGEPPSMTQLLRR

SEQ ID NO: 74 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDAGSEPPSMTQLLRR

SEQ ID NO: 75 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDAGAEPPSMTQLLRR

SEQ ID NO: 76 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDASGEPPSMTQLLRR

SEQ ID NO: 77 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDASSEPPSMTQLLRR

SEQ ID NO: 78 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDASAEPPSMTQLLRR

SEQ ID NO: 79 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDAAGEPPSMTQLLRR

SEQ ID NO: 80 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDAASEPPSMTQLLRR

SEQ ID NO: 81 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKSGVSNKDIEKETAKDAAAEPPSMTQLLRR

SEQ ID NO: 82 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDGGGEPPSMTQLLRR

SEQ ID NO: 83 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDGGSEPPSMTQLLRR

SEQ ID NO: 84 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDGGAEPPSMTQLLRR

SEQ ID NO: 85 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDGSGEPPSMTQLLRR

SEQ ID NO: 86 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDGSSEPPSMTQLLRR

SEQ ID NO: 87 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDGSAEPPSMTQLLRR

SEQ ID NO: 88 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDGAGEPPSMTQLLRR

SEQ ID NO: 89 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDGASEPPSMTQLLRR

SEQ ID NO: 90 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDGAAEPPSMTQLLRR

SEQ ID NO: 91 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDSGGEPPSMTQLLRR

SEQ ID NO: 92 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDSGSEPPSMTQLLRR

SEQ ID NO: 93 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDSGAEPPSMTQLLRR

SEQ ID NO: 94 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDSSGEPPSMTQLLRR

SEQ ID NO: 95 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDSSSEPPSMTQLLRR

SEQ ID NO: 96 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDSSAEPPSMTQLLRR

SEQ ID NO: 97 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDSAGEPPSMTQLLRR

SEQ ID NO: 98 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDSASEPPSMTQLLRR

SEQ ID NO: 99 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDSAAEPPSMTQLLRR

SEQ ID NO: 100 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDAGGEPPSMTQLLRR

SEQ ID NO: 101 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDAGSEPPSMTQLLRR

SEQ ID NO: 102 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDAGAEPPSMTQLLRR

SEQ ID NO: 103 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDASGEPPSMTQLLRR

SEQ ID NO: 104 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDASSEPPSMTQLLRR

SEQ ID NO: 105 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDASAEPPSMTQLLRR

SEQ ID NO: 106 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDAAGEPPSMTQLLRR

SEQ ID NO: 107 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDAASEPPSMTQLLRR

SEQ ID NO: 108 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKAGVSNKDIEKETAKDAAAEPPSMTQLLRR

SEQ ID NO: 109 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDGGGEPPSMTQLLRR

SEQ ID NO: 110 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDGGSEPPSMTQLLRR

SEQ ID NO: 111 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDGGAEPPSMTQLLRR

SEQ ID NO: 112 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDGSGEPPSMTQLLRR

SEQ ID NO: 113 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDGSSEPPSMTQLLRR

SEQ ID NO: 114 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDGSAEPPSMTQLLRR

SEQ ID NO: 115 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDGAGEPPSMTQLLRR

SEQ ID NO: 116 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDGASEPPSMTQLLRR

SEQ ID NO: 117 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDGAAEPPSMTQLLRR

SEQ ID NO: 118 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDSGGEPPSMTQLLRR

SEQ ID NO: 119 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDSGSEPPSMTQLLRR

SEQ ID NO: 120 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDSGAEPPSMTQLLRR

SEQ ID NO: 121 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDSSGEPPSMTQLLRR

SEQ ID NO: 122 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDSSSEPPSMTQLLRR

SEQ ID NO: 123 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDSSAEPPSMTQLLRR

SEQ ID NO: 124 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDSAGEPPSMTQLLRR

SEQ ID NO: 125 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDSASEPPSMTQLLRR

SEQ ID NO: 126 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDSAAEPPSMTQLLRR

SEQ ID NO: 127 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDAGGEPPSMTQLLRR

SEQ ID NO: 128 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDAGSEPPSMTQLLRR

SEQ ID NO: 129 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDAGAEPPSMTQLLRR

SEQ ID NO: 130 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDASGEPPSMTQLLRR

SEQ ID NO: 131 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDASSEPPSMTQLLRR

SEQ ID NO: 132 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDASAEPPSMTQLLRR

SEQ ID NO: 133 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDAAGEPPSMTQLLRR

SEQ ID NO: 134 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDAASEPPSMTQLLRR

SEQ ID NO: 135 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKGGVSNKDIEKETAKDAAAEPPSMTQLLRR

SEQ ID NO: 136 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDGGGEPPSMTQLLRR

SEQ ID NO: 137 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDGGSEPPSMTQLLRR

SEQ ID NO: 138 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDGGAEPPSMTQLLRR

SEQ ID NO: 139 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDGSGEPPSMTQLLRR

SEQ ID NO: 140 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDGSSEPPSMTQLLRR

SEQ ID NO: 141 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDGSAEPPSMTQLLRR

SEQ ID NO: 142 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDGAGEPPSMTQLLRR

SEQ ID NO: 143 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDGASEPPSMTQLLRR

SEQ ID NO: 144 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDGAAEPPSMTQLLRR

SEQ ID NO: 145 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDSGGEPPSMTQLLRR

SEQ ID NO: 146 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDSGSEPPSMTQLLRR

SEQ ID NO: 147 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDSGAEPPSMTQLLRR

SEQ ID NO: 148 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDSSGEPPSMTQLLRR

SEQ ID NO: 149 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDSSSEPPSMTQLLRR

SEQ ID NO: 150 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDSSAEPPSMTQLLRR

SEQ ID NO: 151 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDSAGEPPSMTQLLRR

SEQ ID NO: 152 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDSASEPPSMTQLLRR

SEQ ID NO: 153 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDSAAEPPSMTQLLRR

SEQ ID NO: 154 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDAGGEPPSMTQLLRR

SEQ ID NO: 155 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDAGSEPPSMTQLLRR

SEQ ID NO: 156 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDAGAEPPSMTQLLRR

SEQ ID NO: 157 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDASGEPPSMTQLLRR

SEQ ID NO: 158 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDASSEPPSMTQLLRR

SEQ ID NO: 159 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDASAEPPSMTQLLRR

SEQ ID NO: 160 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDAAGEPPSMTQLLRR

SEQ ID NO: 161 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDAASEPPSMTQLLRR

SEQ ID NO: 162 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKDGVSNKDIEKETAKDAAAEPPSMTQLLRR

SEQ ID NO: 163 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDGGGEPPSMTQLLRR

SEQ ID NO: 164 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDGGSEPPSMTQLLRR

SEQ ID NO: 165 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDGGAEPPSMTQLLRR

SEQ ID NO: 166 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDGSGEPPSMTQLLRR

SEQ ID NO: 167 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDGSSEPPSMTQLLRR

SEQ ID NO: 168 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDGSAEPPSMTQLLRR

SEQ ID NO: 169 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDGAGEPPSMTQLLRR

SEQ ID NO: 170 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDGASEPPSMTQLLRR

SEQ ID NO: 171 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDGAAEPPSMTQLLRR

SEQ ID NO: 172 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDSGGEPPSMTQLLRR

SEQ ID NO: 173 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDSGSEPPSMTQLLRR

SEQ ID NO: 174 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDSGAEPPSMTQLLRR

SEQ ID NO: 175 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDSSGEPPSMTQLLRR

SEQ ID NO: 176 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDSSSEPPSMTQLLRR

SEQ ID NO: 177 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDSSAEPPSMTQLLRR

SEQ ID NO: 178 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDSAGEPPSMTQLLRR

SEQ ID NO: 179 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDSASEPPSMTQLLRR

SEQ ID NO: 180 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDSAAEPPSMTQLLRR

SEQ ID NO: 181 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDAGGEPPSMTQLLRR

SEQ ID NO: 182 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDAGSEPPSMTQLLRR

SEQ ID NO: 183 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDAGAEPPSMTQLLRR

SEQ ID NO: 184 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDASGEPPSMTQLLRR

SEQ ID NO: 185 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDASSEPPSMTQLLRR

SEQ ID NO: 186 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDASAEPPSMTQLLRR

SEQ ID NO: 187 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDAAGEPPSMTQLLRR

SEQ ID NO: 188 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDAASEPPSMTQLLRR

SEQ ID NO: 189 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKHGVSNKDIEKETAKDAAAEPPSMTQLLRR

SEQ ID NO: 190 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDGGGEPPSMTQLLRR

SEQ ID NO: 191 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDGGSEPPSMTQLLRR

SEQ ID NO: 192 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDGGAEPPSMTQLLRR

SEQ ID NO: 193 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDGSGEPPSMTQLLRR

SEQ ID NO: 194 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDGSSEPPSMTQLLRR

SEQ ID NO: 195 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDGSAEPPSMTQLLRR

SEQ ID NO: 196 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDGAGEPPSMTQLLRR

SEQ ID NO: 197 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDGASEPPSMTQLLRR

SEQ ID NO: 198 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDGAAEPPSMTQLLRR

SEQ ID NO: 199 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDSGGEPPSMTQLLRR

SEQ ID NO: 200 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDSGSEPPSMTQLLRR

SEQ ID NO: 201 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDSGAEPPSMTQLLRR

SEQ ID NO: 202 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDSSGEPPSMTQLLRR

SEQ ID NO: 203 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDSSSEPPSMTQLLRR

SEQ ID NO: 204 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDSSAEPPSMTQLLRR

SEQ ID NO: 205 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDSAGEPPSMTQLLRR

SEQ ID NO: 206 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDSASEPPSMTQLLRR

SEQ ID NO: 207 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDSAAEPPSMTQLLRR

SEQ ID NO: 208 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDAGGEPPSMTQLLRR

SEQ ID NO: 209 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDAGSEPPSMTQLLRR

SEQ ID NO: 210 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDAGAEPPSMTQLLRR

SEQ ID NO: 211 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDASGEPPSMTQLLRR

SEQ ID NO: 212 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDASSEPPSMTQLLRR

SEQ ID NO: 213 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDASAEPPSMTQLLRR

SEQ ID NO: 214 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDAAGEPPSMTQLLRR

SEQ ID NO: 215 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDAASEPPSMTQLLRR

SEQ ID NO: 216 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKYGVSNKDIEKETAKDAAAEPPSMTQLLRR

SEQ ID NO: 217 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDGGGEPPSMTQLLRR

SEQ ID NO: 218 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDGGSEPPSMTQLLRR

SEQ ID NO: 219 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDGGAEPPSMTQLLRR

SEQ ID NO: 220 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDGSGEPPSMTQLLRR

SEQ ID NO: 221 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDGSSEPPSMTQLLRR

SEQ ID NO: 222 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDGSAEPPSMTQLLRR

SEQ ID NO: 223 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDGAGEPPSMTQLLRR

SEQ ID NO: 224 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDGASEPPSMTQLLRR

SEQ ID NO: 225 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDGAAEPPSMTQLLRR

SEQ ID NO: 226 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDSGGEPPSMTQLLRR

SEQ ID NO: 227 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDSGSEPPSMTQLLRR

SEQ ID NO: 228 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDSGAEPPSMTQLLRR

SEQ ID NO: 229 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDSSGEPPSMTQLLRR

SEQ ID NO: 230 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDSSSEPPSMTQLLRR

SEQ ID NO: 231 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDSSAEPPSMTQLLRR

SEQ ID NO: 232 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDSAGEPPSMTQLLRR

SEQ ID NO: 233 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDSASEPPSMTQLLRR

SEQ ID NO: 234 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDSAAEPPSMTQLLRR

SEQ ID NO: 235 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDAGGEPPSMTQLLRR

SEQ ID NO: 236 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDAGSEPPSMTQLLRR

SEQ ID NO: 237 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDAGAEPPSMTQLLRR

SEQ ID NO: 238 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDASGEPPSMTQLLRR

SEQ ID NO: 239 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDASSEPPSMTQLLRR

SEQ ID NO: 240 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDASAEPPSMTQLLRR

SEQ ID NO: 241 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDAAGEPPSMTQLLRR

SEQ ID NO: 242 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDAASEPPSMTQLLRR

SEQ ID NO: 243 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKKGVSNKDIEKETAKDAAAEPPSMTQLLRR

SEQ ID NO: 244 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDGGGEPPSMTQLLRR

SEQ ID NO: 245 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDGGSEPPSMTQLLRR

SEQ ID NO: 246 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDGGAEPPSMTQLLRR

SEQ ID NO: 247 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDGSGEPPSMTQLLRR

SEQ ID NO: 248 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDGSSEPPSMTQLLRR

SEQ ID NO: 249 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDGSAEPPSMTQLLRR

SEQ ID NO: 250 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDGAGEPPSMTQLLRR

SEQ ID NO: 251 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDGASEPPSMTQLLRR

SEQ ID NO: 252 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDGAAEPPSMTQLLRR

SEQ ID NO: 253 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDSGGEPPSMTQLLRR

SEQ ID NO: 254 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDSGSEPPSMTQLLRR

SEQ ID NO: 255 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDSGAEPPSMTQLLRR

SEQ ID NO: 256 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDSSGEPPSMTQLLRR

SEQ ID NO: 257 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDSSSEPPSMTQLLRR

SEQ ID NO: 258 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDSSAEPPSMTQLLRR

SEQ ID NO: 259 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDSAGEPPSMTQLLRR

SEQ ID NO: 260 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDSASEPPSMTQLLRR

SEQ ID NO: 261 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDSAAEPPSMTQLLRR

SEQ ID NO: 262 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDAGGEPPSMTQLLRR

SEQ ID NO: 263 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDAGSEPPSMTQLLRR

SEQ ID NO: 264 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDAGAEPPSMTQLLRR

SEQ ID NO: 265 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDASGEPPSMTQLLRR

SEQ ID NO: 266 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDASSEPPSMTQLLRR

SEQ ID NO: 267 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDASAEPPSMTQLLRR

SEQ ID NO: 268 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDAAGEPPSMTQLLRR

SEQ ID NO: 269 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDAASEPPSMTQLLRR

SEQ ID NO: 270 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKNGVSNKDIEKETAKDAAAEPPSMTQLLRR

SEQ ID NO: 271 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDGGGEPPSMTQLLRR

SEQ ID NO: 272 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDGGSEPPSMTQLLRR

SEQ ID NO: 273 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDGGAEPPSMTQLLRR

SEQ ID NO: 274 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDGSGEPPSMTQLLRR

SEQ ID NO: 275 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDGSSEPPSMTQLLRR

SEQ ID NO: 276 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDGSAEPPSMTQLLRR

SEQ ID NO: 277 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDGAGEPPSMTQLLRR

SEQ ID NO: 278 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDGASEPPSMTQLLRR

SEQ ID NO: 279 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDGAAEPPSMTQLLRR

SEQ ID NO: 280 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDSGGEPPSMTQLLRR

SEQ ID NO: 281 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDSGSEPPSMTQLLRR

SEQ ID NO: 282 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDSGAEPPSMTQLLRR

SEQ ID NO: 283 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDSSGEPPSMTQLLRR

SEQ ID NO: 284 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDSSSEPPSMTQLLRR

SEQ ID NO: 285 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDSSAEPPSMTQLLRR

SEQ ID NO: 286 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDSAGEPPSMTQLLRR

SEQ ID NO: 287 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDSASEPPSMTQLLRR

SEQ ID NO: 288 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDSAAEPPSMTQLLRR

SEQ ID NO: 289 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDAGGEPPSMTQLLRR

SEQ ID NO: 290 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDAGSEPPSMTQLLRR

SEQ ID NO: 291 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDAGAEPPSMTQLLRR

SEQ ID NO: 292 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDASGEPPSMTQLLRR

SEQ ID NO: 293 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDASSEPPSMTQLLRR

SEQ ID NO: 294 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDASAEPPSMTQLLRR

SEQ ID NO: 295 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDAAGEPPSMTQLLRR

SEQ ID NO: 296 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDAASEPPSMTQLLRR

SEQ ID NO: 297 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKMGVSNKDIEKETAKDAAAEPPSMTQLLRR

SEQ ID NO: 298 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDGGGEPPSMTQLLRR

SEQ ID NO: 299 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDGGSEPPSMTQLLRR

SEQ ID NO: 300 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDGGAEPPSMTQLLRR

SEQ ID NO: 301 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDGSGEPPSMTQLLRR

SEQ ID NO: 302 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDGSSEPPSMTQLLRR

SEQ ID NO: 303 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDGSAEPPSMTQLLRR

SEQ ID NO: 304 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDGAGEPPSMTQLLRR

SEQ ID NO: 305 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDGASEPPSMTQLLRR

SEQ ID NO: 306 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDGAAEPPSMTQLLRR

SEQ ID NO: 307 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDSGGEPPSMTQLLRR

SEQ ID NO: 308 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDSGSEPPSMTQLLRR

SEQ ID NO: 309 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDSGAEPPSMTQLLRR

SEQ ID NO: 310 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDSSGEPPSMTQLLRR

SEQ ID NO: 311 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDSSSEPPSMTQLLRR

SEQ ID NO: 312 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDSSAEPPSMTQLLRR

SEQ ID NO: 313 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDSAGEPPSMTQLLRR

SEQ ID NO: 314 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDSASEPPSMTQLLRR

SEQ ID NO: 315 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDSAAEPPSMTQLLRR

SEQ ID NO: 316 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDAGGEPPSMTQLLRR

SEQ ID NO: 317 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDAGSEPPSMTQLLRR

SEQ ID NO: 318 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDAGAEPPSMTQLLRR

SEQ ID NO: 319 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDASGEPPSMTQLLRR

SEQ ID NO: 320 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDASSEPPSMTQLLRR

SEQ ID NO: 321 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDASAEPPSMTQLLRR

SEQ ID NO: 322 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDAAGEPPSMTQLLRR

SEQ ID NO: 323 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDAASEPPSMTQLLRR

SEQ ID NO: 324 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKCGVSNKDIEKETAKDAAAEPPSMTQLLRR

SEQ ID NO: 325 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDGGGEPPSMTQLLRR

SEQ ID NO: 326 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDGGSEPPSMTQLLRR

SEQ ID NO: 327 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDGGAEPPSMTQLLRR

SEQ ID NO: 328 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDGSGEPPSMTQLLRR

SEQ ID NO: 329 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDGSSEPPSMTQLLRR

SEQ ID NO: 330 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDGSAEPPSMTQLLRR

SEQ ID NO: 331 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDGAGEPPSMTQLLRR

SEQ ID NO: 332 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDGASEPPSMTQLLRR

SEQ ID NO: 333 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDGAAEPPSMTQLLRR

SEQ ID NO: 334 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDSGGEPPSMTQLLRR

SEQ ID NO: 335 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDSGSEPPSMTQLLRR

SEQ ID NO: 336 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDSGAEPPSMTQLLRR

SEQ ID NO: 337 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDSSGEPPSMTQLLRR

SEQ ID NO: 338 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDSSSEPPSMTQLLRR

SEQ ID NO: 339 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDSSAEPPSMTQLLRR

SEQ ID NO: 340 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDSAGEPPSMTQLLRR

SEQ ID NO: 341 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDSASEPPSMTQLLRR

SEQ ID NO: 342 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDSAAEPPSMTQLLRR

SEQ ID NO: 343 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDAGGEPPSMTQLLRR

SEQ ID NO: 344 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDAGSEPPSMTQLLRR

SEQ ID NO: 345 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDAGAEPPSMTQLLRR

SEQ ID NO: 346 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDASGEPPSMTQLLRR

SEQ ID NO: 347 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDASSEPPSMTQLLRR

SEQ ID NO: 348 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDASAEPPSMTQLLRR

SEQ ID NO: 349 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDAAGEPPSMTQLLRR

SEQ ID NO: 350 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDAASEPPSMTQLLRR

SEQ ID NO: 351 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKSGVSNKDIEKETAKDAAAEPPSMTQLLRR

SEQ ID NO: 352 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDGGGEPPSMTQLLRR

SEQ ID NO: 353 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDGGSEPPSMTQLLRR

SEQ ID NO: 354 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDGGAEPPSMTQLLRR

SEQ ID NO: 355 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDGSGEPPSMTQLLRR

SEQ ID NO: 356 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDGSSEPPSMTQLLRR

SEQ ID NO: 357 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDGSAEPPSMTQLLRR

SEQ ID NO: 358 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDGAGEPPSMTQLLRR

SEQ ID NO: 359 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDGASEPPSMTQLLRR

SEQ ID NO: 360 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDGAAEPPSMTQLLRR

SEQ ID NO: 361 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDSGGEPPSMTQLLRR

SEQ ID NO: 362 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDSGSEPPSMTQLLRR

SEQ ID NO: 363 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDSGAEPPSMTQLLRR

SEQ ID NO: 364 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDSSGEPPSMTQLLRR

SEQ ID NO: 365 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDSSSEPPSMTQLLRR

SEQ ID NO: 366 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDSSAEPPSMTQLLRR

SEQ ID NO: 367 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDSAGEPPSMTQLLRR

SEQ ID NO: 368 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDSASEPPSMTQLLRR

SEQ ID NO: 369 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDSAAEPPSMTQLLRR

SEQ ID NO: 370 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDAGGEPPSMTQLLRR

SEQ ID NO: 371 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDAGSEPPSMTQLLRR

SEQ ID NO: 372 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDAGAEPPSMTQLLRR

SEQ ID NO: 373 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDASGEPPSMTQLLRR

SEQ ID NO: 374 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDASSEPPSMTQLLRR

SEQ ID NO: 375 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDASAEPPSMTQLLRR

SEQ ID NO: 376 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDAAGEPPSMTQLLRR

SEQ ID NO: 377 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDAASEPPSMTQLLRR

SEQ ID NO: 378 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKAGVSNKDIEKETAKDAAAEPPSMTQLLRR

SEQ ID NO: 379 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDGGGEPPSMTQLLRR

SEQ ID NO: 380 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDGGSEPPSMTQLLRR

SEQ ID NO: 381 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDGGAEPPSMTQLLRR

SEQ ID NO: 382 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDGSGEPPSMTQLLRR

SEQ ID NO: 383 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDGSSEPPSMTQLLRR

SEQ ID NO: 384 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDGSAEPPSMTQLLRR

SEQ ID NO: 385 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDGAGEPPSMTQLLRR

SEQ ID NO: 386 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDGASEPPSMTQLLRR

SEQ ID NO: 387 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDGAAEPPSMTQLLRR

SEQ ID NO: 388 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDSGGEPPSMTQLLRR

SEQ ID NO: 389 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDSGSEPPSMTQLLRR

SEQ ID NO: 390 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDSGAEPPSMTQLLRR

SEQ ID NO: 391 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDSSGEPPSMTQLLRR

SEQ ID NO: 392 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDSSSEPPSMTQLLRR

SEQ ID NO: 393 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDSSAEPPSMTQLLRR

SEQ ID NO: 394 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDSAGEPPSMTQLLRR

SEQ ID NO: 395 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDSASEPPSMTQLLRR

SEQ ID NO: 396 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDSAAEPPSMTQLLRR

SEQ ID NO: 397 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDAGGEPPSMTQLLRR

SEQ ID NO: 398 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDAGSEPPSMTQLLRR

SEQ ID NO: 399 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDAGAEPPSMTQLLRR

SEQ ID NO: 400 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDASGEPPSMTQLLRR

SEQ ID NO: 401 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDASSEPPSMTQLLRR

SEQ ID NO: 402 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDASAEPPSMTQLLRR

SEQ ID NO: 403 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDAAGEPPSMTQLLRR

SEQ ID NO: 404 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDAASEPPSMTQLLRR

SEQ ID NO: 405 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKGGVSNKDIEKETAKDAAAEPPSMTQLLRR

SEQ ID NO: 406 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDGGGEPPSMTQLLRR

SEQ ID NO: 407 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDGGSEPPSMTQLLRR

SEQ ID NO: 408 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDGGAEPPSMTQLLRR

SEQ ID NO: 409 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDGSGEPPSMTQLLRR

SEQ ID NO: 410 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDGSSEPPSMTQLLRR

SEQ ID NO: 411 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDGSAEPPSMTQLLRR

SEQ ID NO: 412 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDGAGEPPSMTQLLRR

SEQ ID NO: 413 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDGASEPPSMTQLLRR

SEQ ID NO: 414 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDGAAEPPSMTQLLRR

SEQ ID NO: 415 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDSGGEPPSMTQLLRR

SEQ ID NO: 416 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDSGSEPPSMTQLLRR

SEQ ID NO: 417 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDSGAEPPSMTQLLRR

SEQ ID NO: 418 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDSSGEPPSMTQLLRR

SEQ ID NO: 419 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDSSSEPPSMTQLLRR

SEQ ID NO: 420 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDSSAEPPSMTQLLRR

SEQ ID NO: 421 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDSAGEPPSMTQLLRR

SEQ ID NO: 422 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDSASEPPSMTQLLRR

SEQ ID NO: 423 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDSAAEPPSMTQLLRR

SEQ ID NO: 424 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDAGGEPPSMTQLLRR

SEQ ID NO: 425 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDAGSEPPSMTQLLRR

SEQ ID NO: 426 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDAGAEPPSMTQLLRR

SEQ ID NO: 427 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDASGEPPSMTQLLRR

SEQ ID NO: 428 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDASSEPPSMTQLLRR

SEQ ID NO: 429 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDASAEPPSMTQLLRR

SEQ ID NO: 430 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDAAGEPPSMTQLLRR

SEQ ID NO: 431 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDAASEPPSMTQLLRR

SEQ ID NO: 432 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKDGVSNKDIEKETAKDAAAEPPSMTQLLRR

SEQ ID NO: 433 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDGGGEPPSMTQLLRR

SEQ ID NO: 434 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDGGSEPPSMTQLLRR

SEQ ID NO: 435 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDGGAEPPSMTQLLRR

SEQ ID NO: 436 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDGSGEPPSMTQLLRR

SEQ ID NO: 437 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDGSSEPPSMTQLLRR

SEQ ID NO: 438 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDGSAEPPSMTQLLRR

SEQ ID NO: 439 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDGAGEPPSMTQLLRR

SEQ ID NO: 440 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDGASEPPSMTQLLRR

SEQ ID NO: 441 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDGAAEPPSMTQLLRR

SEQ ID NO: 442 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDSGGEPPSMTQLLRR

SEQ ID NO: 443 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDSGSEPPSMTQLLRR

SEQ ID NO: 444 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDSGAEPPSMTQLLRR

SEQ ID NO: 445 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDSSGEPPSMTQLLRR

SEQ ID NO: 446 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDSSSEPPSMTQLLRR

SEQ ID NO: 447 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDSSAEPPSMTQLLRR

SEQ ID NO: 448 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDSAGEPPSMTQLLRR

SEQ ID NO: 449 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDSASEPPSMTQLLRR

SEQ ID NO: 450 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDSAAEPPSMTQLLRR

SEQ ID NO: 451 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDAGGEPPSMTQLLRR

SEQ ID NO: 452 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDAGSEPPSMTQLLRR

SEQ ID NO: 453 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDAGAEPPSMTQLLRR

SEQ ID NO: 454 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDASGEPPSMTQLLRR

SEQ ID NO: 455 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDASSEPPSMTQLLRR

SEQ ID NO: 456 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDASAEPPSMTQLLRR

SEQ ID NO: 457 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDAAGEPPSMTQLLRR

SEQ ID NO: 458 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDAASEPPSMTQLLRR

SEQ ID NO: 459 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKHGVSNKDIEKETAKDAAAEPPSMTQLLRR

SEQ ID NO: 460 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDGGGEPPSMTQLLRR

SEQ ID NO: 461 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDGGSEPPSMTQLLRR

SEQ ID NO: 462 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDGGAEPPSMTQLLRR

SEQ ID NO: 463 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDGSGEPPSMTQLLRR

SEQ ID NO: 464 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDGSSEPPSMTQLLRR

SEQ ID NO: 465 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDGSAEPPSMTQLLRR

SEQ ID NO: 466 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDGAGEPPSMTQLLRR

SEQ ID NO: 467 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDGASEPPSMTQLLRR

SEQ ID NO: 468 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDGAAEPPSMTQLLRR

SEQ ID NO: 469 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDSGGEPPSMTQLLRR

SEQ ID NO: 470 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDSGSEPPSMTQLLRR

SEQ ID NO: 471 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDSGAEPPSMTQLLRR

SEQ ID NO: 472 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDSSGEPPSMTQLLRR

SEQ ID NO: 473 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDSSSEPPSMTQLLRR

SEQ ID NO: 474 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDSSAEPPSMTQLLRR

SEQ ID NO: 475 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDSAGEPPSMTQLLRR

SEQ ID NO: 476 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDSASEPPSMTQLLRR

SEQ ID NO: 477 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDSAAEPPSMTQLLRR

SEQ ID NO: 478 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDAGGEPPSMTQLLRR

SEQ ID NO: 479 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDAGSEPPSMTQLLRR

SEQ ID NO: 480 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDAGAEPPSMTQLLRR

SEQ ID NO: 481 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDASGEPPSMTQLLRR

SEQ ID NO: 482 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDASSEPPSMTQLLRR

SEQ ID NO: 483 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDASAEPPSMTQLLRR

SEQ ID NO: 484 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDAAGEPPSMTQLLRR

SEQ ID NO: 485 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDAASEPPSMTQLLRR

SEQ ID NO: 486 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKYGVSNKDIEKETAKDAAAEPPSMTQLLRR

SEQ ID NO: 487 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDGGGEPPSMTQLLRR

SEQ ID NO: 488 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDGGSEPPSMTQLLRR

SEQ ID NO: 489 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDGGAEPPSMTQLLRR

SEQ ID NO: 490 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDGSGEPPSMTQLLRR

SEQ ID NO: 491 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDGSSEPPSMTQLLRR

SEQ ID NO: 492 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDGSAEPPSMTQLLRR

SEQ ID NO: 493 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDGAGEPPSMTQLLRR

SEQ ID NO: 494 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDGASEPPSMTQLLRR

SEQ ID NO: 495 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDGAAEPPSMTQLLRR

SEQ ID NO: 496 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDSGGEPPSMTQLLRR

SEQ ID NO: 497 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDSGSEPPSMTQLLRR

SEQ ID NO: 498 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDSGAEPPSMTQLLRR

SEQ ID NO: 499 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDSSGEPPSMTQLLRR

SEQ ID NO: 500 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDSSSEPPSMTQLLRR

SEQ ID NO: 501 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDSSAEPPSMTQLLRR

SEQ ID NO: 502 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDSAGEPPSMTQLLRR

SEQ ID NO: 503 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDSASEPPSMTQLLRR

SEQ ID NO: 504 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDSAAEPPSMTQLLRR

SEQ ID NO: 505 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDAGGEPPSMTQLLRR

SEQ ID NO: 506 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDAGSEPPSMTQLLRR

SEQ ID NO: 507 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDAGAEPPSMTQLLRR

SEQ ID NO: 508 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDASGEPPSMTQLLRR

SEQ ID NO: 509 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDASSEPPSMTQLLRR

SEQ ID NO: 510 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDASAEPPSMTQLLRR

SEQ ID NO: 511 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDAAGEPPSMTQLLRR

SEQ ID NO: 512 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDAASEPPSMTQLLRR

SEQ ID NO: 513 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKKGVSNKDIEKETAKDAAAEPPSMTQLLRR

SEQ ID NO: 514 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDGGGEPPSMTQLLRR

SEQ ID NO: 515 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDGGSEPPSMTQLLRR

SEQ ID NO: 516 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDGGAEPPSMTQLLRR

SEQ ID NO: 517 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDGSGEPPSMTQLLRR

SEQ ID NO: 518 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDGSSEPPSMTQLLRR

SEQ ID NO: 519 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDGSAEPPSMTQLLRR

SEQ ID NO: 520 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDGAGEPPSMTQLLRR

SEQ ID NO: 521 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDGASEPPSMTQLLRR

SEQ ID NO: 522 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDGAAEPPSMTQLLRR

SEQ ID NO: 523 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDSGGEPPSMTQLLRR

SEQ ID NO: 524 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDSGSEPPSMTQLLRR

SEQ ID NO: 525 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDSGAEPPSMTQLLRR

SEQ ID NO: 526 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDSSGEPPSMTQLLRR

SEQ ID NO: 527 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDSSSEPPSMTQLLRR

SEQ ID NO: 528 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDSSAEPPSMTQLLRR

SEQ ID NO: 529 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDSAGEPPSMTQLLRR

SEQ ID NO: 530 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDSASEPPSMTQLLRR

SEQ ID NO: 531 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDSAAEPPSMTQLLRR

SEQ ID NO: 532 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDAGGEPPSMTQLLRR

SEQ ID NO: 533 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDAGSEPPSMTQLLRR

SEQ ID NO: 534 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDAGAEPPSMTQLLRR

SEQ ID NO: 535 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDASGEPPSMTQLLRR

SEQ ID NO: 536 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDASSEPPSMTQLLRR

SEQ ID NO: 537 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDASAEPPSMTQLLRR

SEQ ID NO: 538 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDAAGEPPSMTQLLRR

SEQ ID NO: 539 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDAASEPPSMTQLLRR

SEQ ID NO: 540 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKNGVSNKDIEKETAKDAAAEPPSMTQLLRR

SEQ ID NO: 541 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDGGGEPPSMTQLLRR

SEQ ID NO: 542 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDGGSEPPSMTQLLRR

SEQ ID NO: 543 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDGGAEPPSMTQLLRR

SEQ ID NO: 544 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDGSGEPPSMTQLLRR

SEQ ID NO: 545 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDGSSEPPSMTQLLRR

SEQ ID NO: 546 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDGSAEPPSMTQLLRR

SEQ ID NO: 547 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDGAGEPPSMTQLLRR

SEQ ID NO: 548 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDGASEPPSMTQLLRR

SEQ ID NO: 549 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDGAAEPPSMTQLLRR

SEQ ID NO: 550 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDSGGEPPSMTQLLRR

SEQ ID NO: 551 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDSGSEPPSMTQLLRR

SEQ ID NO: 552 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDSGAEPPSMTQLLRR

SEQ ID NO: 553 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDSSGEPPSMTQLLRR

SEQ ID NO: 554 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDSSSEPPSMTQLLRR

SEQ ID NO: 555 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDSSAEPPSMTQLLRR

SEQ ID NO: 556 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDSAGEPPSMTQLLRR

SEQ ID NO: 557 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDSASEPPSMTQLLRR

SEQ ID NO: 558 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDSAAEPPSMTQLLRR

SEQ ID NO: 559 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDAGGEPPSMTQLLRR

SEQ ID NO: 560 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDAGSEPPSMTQLLRR

SEQ ID NO: 561 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDAGAEPPSMTQLLRR

SEQ ID NO: 562 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDASGEPPSMTQLLRR

SEQ ID NO: 563 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDASSEPPSMTQLLRR

SEQ ID NO: 564 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDASAEPPSMTQLLRR

SEQ ID NO: 565 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDAAGEPPSMTQLLRR

SEQ ID NO: 566 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDAASEPPSMTQLLRR

SEQ ID NO: 567 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDSFGLRGLLHLENASYGIEPLQNSSHFEHIIYRMDDVYKEPLKMGVSNKDIEKETAKDAAAEPPSMTQLLRR

SEQ ID NO: 568 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDGGGEPPSMTQLLRR

SEQ ID NO: 569 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDGGSEPPSMTQLLRR

SEQ ID NO: 570 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDGGAEPPSMTQLLRR

SEQ ID NO: 571 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDGSGEPPSMTQLLRR

SEQ ID NO: 572 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDGSSEPPSMTQLLRR

SEQ ID NO: 573 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDGSAEPPSMTQLLRR

SEQ ID NO: 574 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDGAGEPPSMTQLLRR

SEQ ID NO: 575 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDGASEPPSMTQLLRR

SEQ ID NO: 576 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDGAAEPPSMTQLLRR

SEQ ID NO: 577 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDSGGEPPSMTQLLRR

SEQ ID NO: 578 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDSGSEPPSMTQLLRR

SEQ ID NO: 579 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDSGAEPPSMTQLLRR

SEQ ID NO: 580 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDSSGEPPSMTQLLRR

SEQ ID NO: 581 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDSSSEPPSMTQLLRR

SEQ ID NO: 582 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDSSAEPPSMTQLLRR

SEQ ID NO: 583 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDSAGEPPSMTQLLRR

SEQ ID NO: 584 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDSASEPPSMTQLLRR

SEQ ID NO: 585 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDSAAEPPSMTQLLRR

SEQ ID NO: 586 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDAGGEPPSMTQLLRR

SEQ ID NO: 587 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDAGSEPPSMTQLLRR

SEQ ID NO: 588 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDAGAEPPSMTQLLRR

SEQ ID NO: 589 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDASGEPPSMTQLLRR

SEQ ID NO: 590 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDASSEPPSMTQLLRR

SEQ ID NO: 591 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDASAEPPSMTQLLRR

SEQ ID NO: 592 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDAAGEPPSMTQLLRR

SEQ ID NO: 593 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDAASEPPSMTQLLRR

SEQ ID NO: 594 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKCGVSNKDIEKETAKDAAAEPPSMTQLLRR

SEQ ID NO: 595 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDGGGEPPSMTQLLRR

SEQ ID NO: 596 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDGGSEPPSMTQLLRR

SEQ ID NO: 597 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDGGAEPPSMTQLLRR

SEQ ID NO: 598 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDGSGEPPSMTQLLRR

SEQ ID NO: 599 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDGSSEPPSMTQLLRR

SEQ ID NO: 600 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDGSAEPPSMTQLLRR

SEQ ID NO: 601 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDGAGEPPSMTQLLRR

SEQ ID NO: 602 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDGASEPPSMTQLLRR

SEQ ID NO: 603 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDGAAEPPSMTQLLRR

SEQ ID NO: 604 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDSGGEPPSMTQLLRR

SEQ ID NO: 605 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDSGSEPPSMTQLLRR

SEQ ID NO: 606 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDSGAEPPSMTQLLRR

SEQ ID NO: 607 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDSSGEPPSMTQLLRR

SEQ ID NO: 608 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDSSSEPPSMTQLLRR

SEQ ID NO: 609 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDSSAEPPSMTQLLRR

SEQ ID NO: 610 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDSAGEPPSMTQLLRR

SEQ ID NO: 611 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDSASEPPSMTQLLRR

SEQ ID NO: 612 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDSAAEPPSMTQLLRR

SEQ ID NO: 613 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDAGGEPPSMTQLLRR

SEQ ID NO: 614 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDAGSEPPSMTQLLRR

SEQ ID NO: 615 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDAGAEPPSMTQLLRR

SEQ ID NO: 616 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDASGEPPSMTQLLRR

SEQ ID NO: 617 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDASSEPPSMTQLLRR

SEQ ID NO: 618 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDASAEPPSMTQLLRR

SEQ ID NO: 619 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDAAGEPPSMTQLLRR

SEQ ID NO: 620 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDAASEPPSMTQLLRR

SEQ ID NO: 621 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKSGVSNKDIEKETAKDAAAEPPSMTQLLRR

SEQ ID NO: 622 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDGGGEPPSMTQLLRR

SEQ ID NO: 623 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDGGSEPPSMTQLLRR

SEQ ID NO: 624 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDGGAEPPSMTQLLRR

SEQ ID NO: 625 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDGSGEPPSMTQLLRR

SEQ ID NO: 626 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDGSSEPPSMTQLLRR

SEQ ID NO: 627 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDGSAEPPSMTQLLRR

SEQ ID NO: 628 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDGAGEPPSMTQLLRR

SEQ ID NO: 629 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDGASEPPSMTQLLRR

SEQ ID NO: 630 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDGAAEPPSMTQLLRR

SEQ ID NO: 631 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDSGGEPPSMTQLLRR

SEQ ID NO: 632 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDSGSEPPSMTQLLRR

SEQ ID NO: 633 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDSGAEPPSMTQLLRR

SEQ ID NO: 634 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDSSGEPPSMTQLLRR

SEQ ID NO: 635 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDSSSEPPSMTQLLRR

SEQ ID NO: 636 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDSSAEPPSMTQLLRR

SEQ ID NO: 637 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDSAGEPPSMTQLLRR

SEQ ID NO: 638 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDSASEPPSMTQLLRR

SEQ ID NO: 639 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDSAAEPPSMTQLLRR

SEQ ID NO: 640 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDAGGEPPSMTQLLRR

SEQ ID NO: 641 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDAGSEPPSMTQLLRR

SEQ ID NO: 642 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDAGAEPPSMTQLLRR

SEQ ID NO: 643 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDASGEPPSMTQLLRR

SEQ ID NO: 644 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDASSEPPSMTQLLRR

SEQ ID NO: 645 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDASAEPPSMTQLLRR

SEQ ID NO: 646 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDAAGEPPSMTQLLRR

SEQ ID NO: 647 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDAASEPPSMTQLLRR

SEQ ID NO: 648 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKAGVSNKDIEKETAKDAAAEPPSMTQLLRR

SEQ ID NO: 649 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDGGGEPPSMTQLLRR

SEQ ID NO: 650 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDGGSEPPSMTQLLRR

SEQ ID NO: 651 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDGGAEPPSMTQLLRR

SEQ ID NO: 652 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDGSGEPPSMTQLLRR

SEQ ID NO: 653 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDGSSEPPSMTQLLRR

SEQ ID NO: 654 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDGSAEPPSMTQLLRR

SEQ ID NO: 655 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDGAGEPPSMTQLLRR

SEQ ID NO: 656 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDGASEPPSMTQLLRR

SEQ ID NO: 657 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDGAAEPPSMTQLLRR

SEQ ID NO: 658 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDSGGEPPSMTQLLRR

SEQ ID NO: 659 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDSGSEPPSMTQLLRR

SEQ ID NO: 660 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDSGAEPPSMTQLLRR

SEQ ID NO: 661 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDSSGEPPSMTQLLRR

SEQ ID NO: 662 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDSSSEPPSMTQLLRR

SEQ ID NO: 663 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDSSAEPPSMTQLLRR

SEQ ID NO: 664 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDSAGEPPSMTQLLRR

SEQ ID NO: 665 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDSASEPPSMTQLLRR

SEQ ID NO: 666 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDSAAEPPSMTQLLRR

SEQ ID NO: 667 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDAGGEPPSMTQLLRR

SEQ ID NO: 668 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDAGSEPPSMTQLLRR

SEQ ID NO: 669 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDAGAEPPSMTQLLRR

SEQ ID NO: 670 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDASGEPPSMTQLLRR

SEQ ID NO: 671 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDASSEPPSMTQLLRR

SEQ ID NO: 672 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDASAEPPSMTQLLRR

SEQ ID NO: 673 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDAAGEPPSMTQLLRR

SEQ ID NO: 674 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDAASEPPSMTQLLRR

SEQ ID NO: 675 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKGGVSNKDIEKETAKDAAAEPPSMTQLLRR

SEQ ID NO: 676 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDGGGEPPSMTQLLRR

SEQ ID NO: 677 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDGGSEPPSMTQLLRR

SEQ ID NO: 678 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDGGAEPPSMTQLLRR

SEQ ID NO: 679 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDGSGEPPSMTQLLRR

SEQ ID NO: 680 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDGSSEPPSMTQLLRR

SEQ ID NO: 681 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDGSAEPPSMTQLLRR

SEQ ID NO: 682 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDGAGEPPSMTQLLRR

SEQ ID NO: 683 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDGASEPPSMTQLLRR

SEQ ID NO: 684 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDGAAEPPSMTQLLRR

SEQ ID NO: 685 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDSGGEPPSMTQLLRR

SEQ ID NO: 686 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDSGSEPPSMTQLLRR

SEQ ID NO: 687 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDSGAEPPSMTQLLRR

SEQ ID NO: 688 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDSSGEPPSMTQLLRR

SEQ ID NO: 689 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDSSSEPPSMTQLLRR

SEQ ID NO: 690 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDSSAEPPSMTQLLRR

SEQ ID NO: 691 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDSAGEPPSMTQLLRR

SEQ ID NO: 692 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDSASEPPSMTQLLRR

SEQ ID NO: 693 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDSAAEPPSMTQLLRR

SEQ ID NO: 694 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDAGGEPPSMTQLLRR

SEQ ID NO: 695 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDAGSEPPSMTQLLRR

SEQ ID NO: 696 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDAGAEPPSMTQLLRR

SEQ ID NO: 697 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDASGEPPSMTQLLRR

SEQ ID NO: 698 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDASSEPPSMTQLLRR

SEQ ID NO: 699 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDASAEPPSMTQLLRR

SEQ ID NO: 700 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDAAGEPPSMTQLLRR

SEQ ID NO: 701 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDAASEPPSMTQLLRR

SEQ ID NO: 702 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKDGVSNKDIEKETAKDAAAEPPSMTQLLRR

SEQ ID NO: 703 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDGGGEPPSMTQLLRR

SEQ ID NO: 704 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDGGSEPPSMTQLLRR

SEQ ID NO: 705 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDGGAEPPSMTQLLRR

SEQ ID NO: 706 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDGSGEPPSMTQLLRR

SEQ ID NO: 707 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDGSSEPPSMTQLLRR

SEQ ID NO: 708 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDGSAEPPSMTQLLRR

SEQ ID NO: 709 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDGAGEPPSMTQLLRR

SEQ ID NO: 710 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDGASEPPSMTQLLRR

SEQ ID NO: 711 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDGAAEPPSMTQLLRR

SEQ ID NO: 712 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDSGGEPPSMTQLLRR

SEQ ID NO: 713 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDSGSEPPSMTQLLRR

SEQ ID NO: 714 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDSGAEPPSMTQLLRR

SEQ ID NO: 715 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDSSGEPPSMTQLLRR

SEQ ID NO: 716 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDSSSEPPSMTQLLRR

SEQ ID NO: 717 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDSSAEPPSMTQLLRR

SEQ ID NO: 718 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDSAGEPPSMTQLLRR

SEQ ID NO: 719 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDSASEPPSMTQLLRR

SEQ ID NO: 720 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDSAAEPPSMTQLLRR

SEQ ID NO: 721 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDAGGEPPSMTQLLRR

SEQ ID NO: 722 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDAGSEPPSMTQLLRR

SEQ ID NO: 723 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDAGAEPPSMTQLLRR

SEQ ID NO: 724 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDASGEPPSMTQLLRR

SEQ ID NO: 725 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDASSEPPSMTQLLRR

SEQ ID NO: 726 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDASAEPPSMTQLLRR

SEQ ID NO: 727 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDAAGEPPSMTQLLRR

SEQ ID NO: 728 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDAASEPPSMTQLLRR

SEQ ID NO: 729 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKHGVSNKDIEKETAKDAAAEPPSMTQLLRR

SEQ ID NO: 730 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDGGGEPPSMTQLLRR

SEQ ID NO: 731 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDGGSEPPSMTQLLRR

SEQ ID NO: 732 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDGGAEPPSMTQLLRR

SEQ ID NO: 733 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDGSGEPPSMTQLLRR

SEQ ID NO: 734 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDGSSEPPSMTQLLRR

SEQ ID NO: 735 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDGSAEPPSMTQLLRR

SEQ ID NO: 736 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDGAGEPPSMTQLLRR

SEQ ID NO: 737 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDGASEPPSMTQLLRR

SEQ ID NO: 738 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDGAAEPPSMTQLLRR

SEQ ID NO: 739 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDSGGEPPSMTQLLRR

SEQ ID NO: 740 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDSGSEPPSMTQLLRR

SEQ ID NO: 741 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDSGAEPPSMTQLLRR

SEQ ID NO: 742 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDSSGEPPSMTQLLRR

SEQ ID NO: 743 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDSSSEPPSMTQLLRR

SEQ ID NO: 744 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDSSAEPPSMTQLLRR

SEQ ID NO: 745 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDSAGEPPSMTQLLRR

SEQ ID NO: 746 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDSASEPPSMTQLLRR

SEQ ID NO: 747 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDSAAEPPSMTQLLRR

SEQ ID NO: 748 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDAGGEPPSMTQLLRR

SEQ ID NO: 749 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDAGSEPPSMTQLLRR

SEQ ID NO: 750 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDAGAEPPSMTQLLRR

SEQ ID NO: 751 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDASGEPPSMTQLLRR

SEQ ID NO: 752 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDASSEPPSMTQLLRR

SEQ ID NO: 753 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDASAEPPSMTQLLRR

SEQ ID NO: 754 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDAAGEPPSMTQLLRR

SEQ ID NO: 755 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDAASEPPSMTQLLRR

SEQ ID NO: 756 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKYGVSNKDIEKETAKDAAAEPPSMTQLLRR

SEQ ID NO: 757 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDGGGEPPSMTQLLRR

SEQ ID NO: 758 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDGGSEPPSMTQLLRR

SEQ ID NO: 759 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDGGAEPPSMTQLLRR

SEQ ID NO: 760 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDGSGEPPSMTQLLRR

SEQ ID NO: 761 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDGSSEPPSMTQLLRR

SEQ ID NO: 762 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDGSAEPPSMTQLLRR

SEQ ID NO: 763 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDGAGEPPSMTQLLRR

SEQ ID NO: 764 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDGASEPPSMTQLLRR

SEQ ID NO: 765 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDGAAEPPSMTQLLRR

SEQ ID NO: 766 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDSGGEPPSMTQLLRR

SEQ ID NO: 767 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDSGSEPPSMTQLLRR

SEQ ID NO: 768 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDSGAEPPSMTQLLRR

SEQ ID NO: 769 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDSSGEPPSMTQLLRR

SEQ ID NO: 770 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDSSSEPPSMTQLLRR

SEQ ID NO: 771 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDSSAEPPSMTQLLRR

SEQ ID NO: 772 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDSAGEPPSMTQLLRR

SEQ ID NO: 773 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDSASEPPSMTQLLRR

SEQ ID NO: 774 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDSAAEPPSMTQLLRR

SEQ ID NO: 775 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDAGGEPPSMTQLLRR

SEQ ID NO: 776 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDAGSEPPSMTQLLRR

SEQ ID NO: 777 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDAGAEPPSMTQLLRR

SEQ ID NO: 778 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDASGEPPSMTQLLRR

SEQ ID NO: 779 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDASSEPPSMTQLLRR

SEQ ID NO: 780 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDASAEPPSMTQLLRR

SEQ ID NO: 781 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDAAGEPPSMTQLLRR

SEQ ID NO: 782 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDAASEPPSMTQLLRR

SEQ ID NO: 783 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKKGVSNKDIEKETAKDAAAEPPSMTQLLRR

SEQ ID NO: 784 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDGGGEPPSMTQLLRR

SEQ ID NO: 785 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDGGSEPPSMTQLLRR

SEQ ID NO: 786 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDGGAEPPSMTQLLRR

SEQ ID NO: 787 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDGSGEPPSMTQLLRR

SEQ ID NO: 788 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDGSSEPPSMTQLLRR

SEQ ID NO: 789 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDGSAEPPSMTQLLRR

SEQ ID NO: 790 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDGAGEPPSMTQLLRR

SEQ ID NO: 791 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDGASEPPSMTQLLRR

SEQ ID NO: 792 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDGAAEPPSMTQLLRR

SEQ ID NO: 793 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDSGGEPPSMTQLLRR

SEQ ID NO: 794 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDSGSEPPSMTQLLRR

SEQ ID NO: 795 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDSGAEPPSMTQLLRR

SEQ ID NO: 796 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDSSGEPPSMTQLLRR

SEQ ID NO: 797 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDSSSEPPSMTQLLRR

SEQ ID NO: 798 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDSSAEPPSMTQLLRR

SEQ ID NO: 799 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDSAGEPPSMTQLLRR

SEQ ID NO: 800 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDSASEPPSMTQLLRR

SEQ ID NO: 801 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDSAAEPPSMTQLLRR

SEQ ID NO: 802 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDAGGEPPSMTQLLRR

SEQ ID NO: 803 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDAGSEPPSMTQLLRR

SEQ ID NO: 804 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDAGAEPPSMTQLLRR

SEQ ID NO: 805 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDASGEPPSMTQLLRR

SEQ ID NO: 806 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDASSEPPSMTQLLRR

SEQ ID NO: 807 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDASAEPPSMTQLLRR

SEQ ID NO: 808 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDAAGEPPSMTQLLRR

SEQ ID NO: 809 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDAASEPPSMTQLLRR

SEQ ID NO: 810 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKNGVSNKDIEKETAKDAAAEPPSMTQLLRR

SEQ ID NO: 811 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDGGGEPPSMTQLLRR

SEQ ID NO: 812 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDGGSEPPSMTQLLRR

SEQ ID NO: 813 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDGGAEPPSMTQLLRR

SEQ ID NO: 814 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDGSGEPPSMTQLLRR

SEQ ID NO: 815 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDGSSEPPSMTQLLRR

SEQ ID NO: 816 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDGSAEPPSMTQLLRR

SEQ ID NO: 817 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDGAGEPPSMTQLLRR

SEQ ID NO: 818 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDGASEPPSMTQLLRR

SEQ ID NO: 819 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDGAAEPPSMTQLLRR

SEQ ID NO: 820 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDSGGEPPSMTQLLRR

SEQ ID NO: 821 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDSGSEPPSMTQLLRR

SEQ ID NO: 822 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDSGAEPPSMTQLLRR

SEQ ID NO: 823 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDSSGEPPSMTQLLRR

SEQ ID NO: 824 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDSSSEPPSMTQLLRR

SEQ ID NO: 825 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDSSAEPPSMTQLLRR

SEQ ID NO: 826 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDSAGEPPSMTQLLRR

SEQ ID NO: 827 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDSASEPPSMTQLLRR

SEQ ID NO: 828 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDSAAEPPSMTQLLRR

SEQ ID NO: 829 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDAGGEPPSMTQLLRR

SEQ ID NO: 830 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDAGSEPPSMTQLLRR

SEQ ID NO: 831 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDAGAEPPSMTQLLRR

SEQ ID NO: 832 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDASGEPPSMTQLLRR

SEQ ID NO: 833 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDASSEPPSMTQLLRR

SEQ ID NO: 834 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDASAEPPSMTQLLRR

SEQ ID NO: 835 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDAAGEPPSMTQLLRR

SEQ ID NO: 836 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDAASEPPSMTQLLRR

SEQ ID NO: 837 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDAFGLRGLLHLENASYGIEPLQNSSHFEHIIYRMDDVYKEPLKMGVSNKDIEKETAKDAAAEPPSMTQLLRR

SEQ ID NO: 838 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDGGGEPPSMTQLLRR

SEQ ID NO: 839 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDGGSEPPSMTQLLRR

SEQ ID NO: 840 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDGGAEPPSMTQLLRR

SEQ ID NO: 841 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDGSGEPPSMTQLLRR

SEQ ID NO: 842 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDGSSEPPSMTQLLRR

SEQ ID NO: 843 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDGSAEPPSMTQLLRR

SEQ ID NO: 844 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDGAGEPPSMTQLLRR

SEQ ID NO: 845 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDGASEPPSMTQLLRR

SEQ ID NO: 846 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDGAAEPPSMTQLLRR

SEQ ID NO: 847 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDSGGEPPSMTQLLRR

SEQ ID NO: 848 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDSGSEPPSMTQLLRR

SEQ ID NO: 849 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDSGAEPPSMTQLLRR

SEQ ID NO: 850 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDSSGEPPSMTQLLRR

SEQ ID NO: 851 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDSSSEPPSMTQLLRR

SEQ ID NO: 852 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDSSAEPPSMTQLLRR

SEQ ID NO: 853 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDSAGEPPSMTQLLRR

SEQ ID NO: 854 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDSASEPPSMTQLLRR

SEQ ID NO: 855 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDSAAEPPSMTQLLRR

SEQ ID NO: 856 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDAGGEPPSMTQLLRR

SEQ ID NO: 857 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDAGSEPPSMTQLLRR

SEQ ID NO: 858 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDAGAEPPSMTQLLRR

SEQ ID NO: 859 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDASGEPPSMTQLLRR

SEQ ID NO: 860 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDASSEPPSMTQLLRR

SEQ ID NO: 861 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDASAEPPSMTQLLRR

SEQ ID NO: 862 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDAAGEPPSMTQLLRR

SEQ ID NO: 863 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDAASEPPSMTQLLRR

SEQ ID NO: 864 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKCGVSNKDIEKETAKDAAAEPPSMTQLLRR

SEQ ID NO: 865 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDGGGEPPSMTQLLRR

SEQ ID NO: 866 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDGGSEPPSMTQLLRR

SEQ ID NO: 867 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDGGAEPPSMTQLLRR

SEQ ID NO: 868 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDGSGEPPSMTQLLRR

SEQ ID NO: 869 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDGSSEPPSMTQLLRR

SEQ ID NO: 870 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDGSAEPPSMTQLLRR

SEQ ID NO: 871 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDGAGEPPSMTQLLRR

SEQ ID NO: 872 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDGASEPPSMTQLLRR

SEQ ID NO: 873 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDGAAEPPSMTQLLRR

SEQ ID NO: 874 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDSGGEPPSMTQLLRR

SEQ ID NO: 875 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDSGSEPPSMTQLLRR

SEQ ID NO: 876 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDSGAEPPSMTQLLRR

SEQ ID NO: 877 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDSSGEPPSMTQLLRR

SEQ ID NO: 878 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDSSSEPPSMTQLLRR

SEQ ID NO: 879 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDSSAEPPSMTQLLRR

SEQ ID NO: 880 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDSAGEPPSMTQLLRR

SEQ ID NO: 881 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDSASEPPSMTQLLRR

SEQ ID NO: 882 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDSAAEPPSMTQLLRR

SEQ ID NO: 883 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDAGGEPPSMTQLLRR

SEQ ID NO: 884 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDAGSEPPSMTQLLRR

SEQ ID NO: 885 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDAGAEPPSMTQLLRR

SEQ ID NO: 886 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDASGEPPSMTQLLRR

SEQ ID NO: 887 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDASSEPPSMTQLLRR

SEQ ID NO: 888 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDASAEPPSMTQLLRR

SEQ ID NO: 889 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDAAGEPPSMTQLLRR

SEQ ID NO: 890 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDAASEPPSMTQLLRR

SEQ ID NO: 891 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKSGVSNKDIEKETAKDAAAEPPSMTQLLRR

SEQ ID NO: 892 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDGGGEPPSMTQLLRR

SEQ ID NO: 893 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDGGSEPPSMTQLLRR

SEQ ID NO: 894 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDGGAEPPSMTQLLRR

SEQ ID NO: 895 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDGSGEPPSMTQLLRR

SEQ ID NO: 896 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDGSSEPPSMTQLLRR

SEQ ID NO: 897 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDGSAEPPSMTQLLRR

SEQ ID NO: 898 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDGAGEPPSMTQLLRR

SEQ ID NO: 899 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDGASEPPSMTQLLRR

SEQ ID NO: 900 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDGAAEPPSMTQLLRR

SEQ ID NO: 901 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDSGGEPPSMTQLLRR

SEQ ID NO: 902 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDSGSEPPSMTQLLRR

SEQ ID NO: 903 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDSGAEPPSMTQLLRR

SEQ ID NO: 904 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDSSGEPPSMTQLLRR

SEQ ID NO: 905 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDSSSEPPSMTQLLRR

SEQ ID NO: 906 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDSSAEPPSMTQLLRR

SEQ ID NO: 907 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDSAGEPPSMTQLLRR

SEQ ID NO: 908 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDSASEPPSMTQLLRR

SEQ ID NO: 909 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDSAAEPPSMTQLLRR

SEQ ID NO: 910 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDAGGEPPSMTQLLRR

SEQ ID NO: 911 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDAGSEPPSMTQLLRR

SEQ ID NO: 912 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDAGAEPPSMTQLLRR

SEQ ID NO: 913 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDASGEPPSMTQLLRR

SEQ ID NO: 914 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDASSEPPSMTQLLRR

SEQ ID NO: 915 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDASAEPPSMTQLLRR

SEQ ID NO: 916 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDAAGEPPSMTQLLRR

SEQ ID NO: 917 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDAASEPPSMTQLLRR

SEQ ID NO: 918 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKAGVSNKDIEKETAKDAAAEPPSMTQLLRR

SEQ ID NO: 919 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDGGGEPPSMTQLLRR

SEQ ID NO: 920 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDGGSEPPSMTQLLRR

SEQ ID NO: 921 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDGGAEPPSMTQLLRR

SEQ ID NO: 922 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDGSGEPPSMTQLLRR

SEQ ID NO: 923 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDGSSEPPSMTQLLRR

SEQ ID NO: 924 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDGSAEPPSMTQLLRR

SEQ ID NO: 925 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDGAGEPPSMTQLLRR

SEQ ID NO: 926 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDGASEPPSMTQLLRR

SEQ ID NO: 927 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDGAAEPPSMTQLLRR

SEQ ID NO: 928 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDSGGEPPSMTQLLRR

SEQ ID NO: 929 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDSGSEPPSMTQLLRR

SEQ ID NO: 930 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDSGAEPPSMTQLLRR

SEQ ID NO: 931 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDSSGEPPSMTQLLRR

SEQ ID NO: 932 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDSSSEPPSMTQLLRR

SEQ ID NO: 933 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDSSAEPPSMTQLLRR

SEQ ID NO: 934 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDSAGEPPSMTQLLRR

SEQ ID NO: 935 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDSASEPPSMTQLLRR

SEQ ID NO: 936 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDSAAEPPSMTQLLRR

SEQ ID NO: 937 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDAGGEPPSMTQLLRR

SEQ ID NO: 938 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDAGSEPPSMTQLLRR

SEQ ID NO: 939 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDAGAEPPSMTQLLRR

SEQ ID NO: 940 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDASGEPPSMTQLLRR

SEQ ID NO: 941 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDASSEPPSMTQLLRR

SEQ ID NO: 942 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDASAEPPSMTQLLRR

SEQ ID NO: 943 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDAAGEPPSMTQLLRR

SEQ ID NO: 944 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDAASEPPSMTQLLRR

SEQ ID NO: 945 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKGGVSNKDIEKETAKDAAAEPPSMTQLLRR

SEQ ID NO: 946 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDGGGEPPSMTQLLRR

SEQ ID NO: 947 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDGGSEPPSMTQLLRR

SEQ ID NO: 948 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDGGAEPPSMTQLLRR

SEQ ID NO: 949 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDGSGEPPSMTQLLRR

SEQ ID NO: 950 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDGSSEPPSMTQLLRR

SEQ ID NO: 951 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDGSAEPPSMTQLLRR

SEQ ID NO: 952 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDGAGEPPSMTQLLRR

SEQ ID NO: 953 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDGASEPPSMTQLLRR

SEQ ID NO: 954 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDGAAEPPSMTQLLRR

SEQ ID NO: 955 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDSGGEPPSMTQLLRR

SEQ ID NO: 956 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDSGSEPPSMTQLLRR

SEQ ID NO: 957 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDSGAEPPSMTQLLRR

SEQ ID NO: 958 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDSSGEPPSMTQLLRR

SEQ ID NO: 959 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDSSSEPPSMTQLLRR

SEQ ID NO: 960 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDSSAEPPSMTQLLRR

SEQ ID NO: 961 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDSAGEPPSMTQLLRR

SEQ ID NO: 962 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDSASEPPSMTQLLRR

SEQ ID NO: 963 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDSAAEPPSMTQLLRR

SEQ ID NO: 964 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDAGGEPPSMTQLLRR

SEQ ID NO: 965 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDAGSEPPSMTQLLRR

SEQ ID NO: 966 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDAGAEPPSMTQLLRR

SEQ ID NO: 967 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDASGEPPSMTQLLRR

SEQ ID NO: 968 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDASSEPPSMTQLLRR

SEQ ID NO: 969 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDASAEPPSMTQLLRR

SEQ ID NO: 970 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDAAGEPPSMTQLLRR

SEQ ID NO: 971 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDAASEPPSMTQLLRR

SEQ ID NO: 972 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKDGVSNKDIEKETAKDAAAEPPSMTQLLRR

SEQ ID NO: 973 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDGGGEPPSMTQLLRR

SEQ ID NO: 974 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDGGSEPPSMTQLLRR

SEQ ID NO: 975 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDGGAEPPSMTQLLRR

SEQ ID NO: 976 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDGSGEPPSMTQLLRR

SEQ ID NO: 977 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDGSSEPPSMTQLLRR

SEQ ID NO: 978 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDGSAEPPSMTQLLRR

SEQ ID NO: 979 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDGAGEPPSMTQLLRR

SEQ ID NO: 980 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDGASEPPSMTQLLRR

SEQ ID NO: 981 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDGAAEPPSMTQLLRR

SEQ ID NO: 982 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDSGGEPPSMTQLLRR

SEQ ID NO: 983 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDSGSEPPSMTQLLRR

SEQ ID NO: 984 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDSGAEPPSMTQLLRR

SEQ ID NO: 985 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDSSGEPPSMTQLLRR

SEQ ID NO: 986 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDSSSEPPSMTQLLRR

SEQ ID NO: 987 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDSSAEPPSMTQLLRR

SEQ ID NO: 988 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDSAGEPPSMTQLLRR

SEQ ID NO: 989 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDSASEPPSMTQLLRR

SEQ ID NO: 990 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDSAAEPPSMTQLLRR

SEQ ID NO: 991 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDAGGEPPSMTQLLRR

SEQ ID NO: 992 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDAGSEPPSMTQLLRR

SEQ ID NO: 993 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDAGAEPPSMTQLLRR

SEQ ID NO: 994 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDASGEPPSMTQLLRR

SEQ ID NO: 995 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDASSEPPSMTQLLRR

SEQ ID NO: 996 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDASAEPPSMTQLLRR

SEQ ID NO: 997 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDAAGEPPSMTQLLRR

SEQ ID NO: 998 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDAASEPPSMTQLLRR

SEQ ID NO: 999 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKHGVSNKDIEKETAKDAAAEPPSMTQLLRR

SEQ ID NO: 1000 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDGGGEPPSMTQLLRR

SEQ ID NO: 1001 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDGGSEPPSMTQLLRR

SEQ ID NO: 1002 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDGGAEPPSMTQLLRR

SEQ ID NO: 1003 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDGSGEPPSMTQLLRR

SEQ ID NO: 1004 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDGSSEPPSMTQLLRR

SEQ ID NO: 1005 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDGSAEPPSMTQLLRR

SEQ ID NO: 1006 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDGAGEPPSMTQLLRR

SEQ ID NO: 1007 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDGASEPPSMTQLLRR

SEQ ID NO: 1008 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDGAAEPPSMTQLLRR

SEQ ID NO: 1009 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDSGGEPPSMTQLLRR

SEQ ID NO: 1010 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDSGSEPPSMTQLLRR

SEQ ID NO: 1011 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDSGAEPPSMTQLLRR

SEQ ID NO: 1012 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDSSGEPPSMTQLLRR

SEQ ID NO: 1013 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDSSSEPPSMTQLLRR

SEQ ID NO: 1014 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDSSAEPPSMTQLLRR

SEQ ID NO: 1015 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDSAGEPPSMTQLLRR

SEQ ID NO: 1016 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDSASEPPSMTQLLRR

SEQ ID NO: 1017 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDSAAEPPSMTQLLRR

SEQ ID NO: 1018 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDAGGEPPSMTQLLRR

SEQ ID NO: 1019 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDAGSEPPSMTQLLRR

SEQ ID NO: 1020 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDAGAEPPSMTQLLRR

SEQ ID NO: 1021 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDASGEPPSMTQLLRR

SEQ ID NO: 1022 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDASSEPPSMTQLLRR

SEQ ID NO: 1023 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDASAEPPSMTQLLRR

SEQ ID NO: 1024 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDAAGEPPSMTQLLRR

SEQ ID NO: 1025 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDAASEPPSMTQLLRR

SEQ ID NO: 1026 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKYGVSNKDIEKETAKDAAAEPPSMTQLLRR

SEQ ID NO: 1027 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDGGGEPPSMTQLLRR

SEQ ID NO: 1028 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDGGSEPPSMTQLLRR

SEQ ID NO: 1029 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDGGAEPPSMTQLLRR

SEQ ID NO: 1030 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDGSGEPPSMTQLLRR

SEQ ID NO: 1031 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDGSSEPPSMTQLLRR

SEQ ID NO: 1032 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDGSAEPPSMTQLLRR

SEQ ID NO: 1033 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDGAGEPPSMTQLLRR

SEQ ID NO: 1034 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDGASEPPSMTQLLRR

SEQ ID NO: 1035 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDGAAEPPSMTQLLRR

SEQ ID NO: 1036 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDSGGEPPSMTQLLRR

SEQ ID NO: 1037 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDSGSEPPSMTQLLRR

SEQ ID NO: 1038 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDSGAEPPSMTQLLRR

SEQ ID NO: 1039 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDSSGEPPSMTQLLRR

SEQ ID NO: 1040 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDSSSEPPSMTQLLRR

SEQ ID NO: 1041 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDSSAEPPSMTQLLRR

SEQ ID NO: 1042 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDSAGEPPSMTQLLRR

SEQ ID NO: 1043 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDSASEPPSMTQLLRR

SEQ ID NO: 1044 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDSAAEPPSMTQLLRR

SEQ ID NO: 1045 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDAGGEPPSMTQLLRR

SEQ ID NO: 1046 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDAGSEPPSMTQLLRR

SEQ ID NO: 1047 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDAGAEPPSMTQLLRR

SEQ ID NO: 1048 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDASGEPPSMTQLLRR

SEQ ID NO: 1049 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDASSEPPSMTQLLRR

SEQ ID NO: 1050 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDASAEPPSMTQLLRR

SEQ ID NO: 1051 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDAAGEPPSMTQLLRR

SEQ ID NO: 1052 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDAASEPPSMTQLLRR

SEQ ID NO: 1053 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKKGVSNKDIEKETAKDAAAEPPSMTQLLRR

SEQ ID NO: 1054 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDGGGEPPSMTQLLRR

SEQ ID NO: 1055 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDGGSEPPSMTQLLRR

SEQ ID NO: 1056 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDGGAEPPSMTQLLRR

SEQ ID NO: 1057 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDGSGEPPSMTQLLRR

SEQ ID NO: 1058 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDGSSEPPSMTQLLRR

SEQ ID NO: 1059 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDGSAEPPSMTQLLRR

SEQ ID NO: 1060 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDGAGEPPSMTQLLRR

SEQ ID NO: 1061 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDGASEPPSMTQLLRR

SEQ ID NO: 1062 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDGAAEPPSMTQLLRR

SEQ ID NO: 1063 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDSGGEPPSMTQLLRR

SEQ ID NO: 1064 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDSGSEPPSMTQLLRR

SEQ ID NO: 1065 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDSGAEPPSMTQLLRR

SEQ ID NO: 1066 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDSSGEPPSMTQLLRR

SEQ ID NO: 1067 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDSSSEPPSMTQLLRR

SEQ ID NO: 1068 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDSSAEPPSMTQLLRR

SEQ ID NO: 1069 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDSAGEPPSMTQLLRR

SEQ ID NO: 1070 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDSASEPPSMTQLLRR

SEQ ID NO: 1071 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDSAAEPPSMTQLLRR

SEQ ID NO: 1072 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDAGGEPPSMTQLLRR

SEQ ID NO: 1073 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDAGSEPPSMTQLLRR

SEQ ID NO: 1074 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDAGAEPPSMTQLLRR

SEQ ID NO: 1075 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDASGEPPSMTQLLRR

SEQ ID NO: 1076 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDASSEPPSMTQLLRR

SEQ ID NO: 1077 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDASAEPPSMTQLLRR

SEQ ID NO: 1078 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDAAGEPPSMTQLLRR

SEQ ID NO: 1079 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDAASEPPSMTQLLRR

SEQ ID NO: 1080 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKNGVSNKDIEKETAKDAAAEPPSMTQLLRR

SEQ ID NO: 1081 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDGGGEPPSMTQLLRR

SEQ ID NO: 1082 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDGGSEPPSMTQLLRR

SEQ ID NO: 1083 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDGGAEPPSMTQLLRR

SEQ ID NO: 1084 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDGSGEPPSMTQLLRR

SEQ ID NO: 1085 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDGSSEPPSMTQLLRR

SEQ ID NO: 1086 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDGSAEPPSMTQLLRR

SEQ ID NO: 1087 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDGAGEPPSMTQLLRR

SEQ ID NO: 1088 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDGASEPPSMTQLLRR

SEQ ID NO: 1089 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDGAAEPPSMTQLLRR

SEQ ID NO: 1090 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDSGGEPPSMTQLLRR

SEQ ID NO: 1091 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDSGSEPPSMTQLLRR

SEQ ID NO: 1092 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDSGAEPPSMTQLLRR

SEQ ID NO: 1093 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDSSGEPPSMTQLLRR

SEQ ID NO: 1094 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDSSSEPPSMTQLLRR

SEQ ID NO: 1095 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDSSAEPPSMTQLLRR

SEQ ID NO: 1096 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDSAGEPPSMTQLLRR

SEQ ID NO: 1097 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDSASEPPSMTQLLRR

SEQ ID NO: 1098 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDSAAEPPSMTQLLRR

SEQ ID NO: 1099 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDAGGEPPSMTQLLRR

SEQ ID NO: 1100 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDAGSEPPSMTQLLRR

SEQ ID NO: 1101 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDAGAEPPSMTQLLRR

SEQ ID NO: 1102 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDASGEPPSMTQLLRR

SEQ ID NO: 1103 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDASSEPPSMTQLLRR

SEQ ID NO: 1104 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDASAEPPSMTQLLRR

SEQ ID NO: 1105 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDAAGEPPSMTQLLRR

SEQ ID NO: 1106 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDAASEPPSMTQLLRR

SEQ ID NO: 1107 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDGFGLRGLLHLENASYGIEPLQNSSHFEHIIYRMDDVYKEPLKMGVSNKDIEKETAKDAAAEPPSMTQLLRR

SEQ ID NO: 1108 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDGGGEPPSMTQLLRR

SEQ ID NO: 1109 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDGGSEPPSMTQLLRR

SEQ ID NO: 1110 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDGGAEPPSMTQLLRR

SEQ ID NO: 1111 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDGSGEPPSMTQLLRR

SEQ ID NO: 1112 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDGSSEPPSMTQLLRR

SEQ ID NO: 1113 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDGSAEPPSMTQLLRR

SEQ ID NO: 1114 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDGAGEPPSMTQLLRR

SEQ ID NO: 1115 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDGASEPPSMTQLLRR

SEQ ID NO: 1116 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDGAAEPPSMTQLLRR

SEQ ID NO: 1117 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDSGGEPPSMTQLLRR

SEQ ID NO: 1118 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDSGSEPPSMTQLLRR

SEQ ID NO: 1119 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDSGAEPPSMTQLLRR

SEQ ID NO: 1120 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDSSGEPPSMTQLLRR

SEQ ID NO: 1121 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDSSSEPPSMTQLLRR

SEQ ID NO: 1122 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDSSAEPPSMTQLLRR

SEQ ID NO: 1123 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDSAGEPPSMTQLLRR

SEQ ID NO: 1124 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDSASEPPSMTQLLRR

SEQ ID NO: 1125 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDSAAEPPSMTQLLRR

SEQ ID NO: 1126 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDAGGEPPSMTQLLRR

SEQ ID NO: 1127 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDAGSEPPSMTQLLRR

SEQ ID NO: 1128 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDAGAEPPSMTQLLRR

SEQ ID NO: 1129 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDASGEPPSMTQLLRR

SEQ ID NO: 1130 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDASSEPPSMTQLLRR

SEQ ID NO: 1131 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDASAEPPSMTQLLRR

SEQ ID NO: 1132 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDAAGEPPSMTQLLRR

SEQ ID NO: 1133 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDAASEPPSMTQLLRR

SEQ ID NO: 1134 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKCGVSNKDIEKETAKDAAAEPPSMTQLLRR

SEQ ID NO: 1135 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDGGGEPPSMTQLLRR

SEQ ID NO: 1136 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDGGSEPPSMTQLLRR

SEQ ID NO: 1137 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDGGAEPPSMTQLLRR

SEQ ID NO: 1138 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDGSGEPPSMTQLLRR

SEQ ID NO: 1139 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDGSSEPPSMTQLLRR

SEQ ID NO: 1140 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDGSAEPPSMTQLLRR

SEQ ID NO: 1141 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDGAGEPPSMTQLLRR

SEQ ID NO: 1142 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDGASEPPSMTQLLRR

SEQ ID NO: 1143 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDGAAEPPSMTQLLRR

SEQ ID NO: 1144 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDSGGEPPSMTQLLRR

SEQ ID NO: 1145 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDSGSEPPSMTQLLRR

SEQ ID NO: 1146 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDSGAEPPSMTQLLRR

SEQ ID NO: 1147 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDSSGEPPSMTQLLRR

SEQ ID NO: 1148 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDSSSEPPSMTQLLRR

SEQ ID NO: 1149 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDSSAEPPSMTQLLRR

SEQ ID NO: 1150 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDSAGEPPSMTQLLRR

SEQ ID NO: 1151 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDSASEPPSMTQLLRR

SEQ ID NO: 1152 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDSAAEPPSMTQLLRR

SEQ ID NO: 1153 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDAGGEPPSMTQLLRR

SEQ ID NO: 1154 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDAGSEPPSMTQLLRR

SEQ ID NO: 1155 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDAGAEPPSMTQLLRR

SEQ ID NO: 1156 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDASGEPPSMTQLLRR

SEQ ID NO: 1157 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDASSEPPSMTQLLRR

SEQ ID NO: 1158 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDASAEPPSMTQLLRR

SEQ ID NO: 1159 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDAAGEPPSMTQLLRR

SEQ ID NO: 1160 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDAASEPPSMTQLLRR

SEQ ID NO: 1161 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKSGVSNKDIEKETAKDAAAEPPSMTQLLRR

SEQ ID NO: 1162 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDGGGEPPSMTQLLRR

SEQ ID NO: 1163 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDGGSEPPSMTQLLRR

SEQ ID NO: 1164 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDGGAEPPSMTQLLRR

SEQ ID NO: 1165 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDGSGEPPSMTQLLRR

SEQ ID NO: 1166 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDGSSEPPSMTQLLRR

SEQ ID NO: 1167 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDGSAEPPSMTQLLRR

SEQ ID NO: 1168 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDGAGEPPSMTQLLRR

SEQ ID NO: 1169 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDGASEPPSMTQLLRR

SEQ ID NO: 1170 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDGAAEPPSMTQLLRR

SEQ ID NO: 1171 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDSGGEPPSMTQLLRR

SEQ ID NO: 1172 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDSGSEPPSMTQLLRR

SEQ ID NO: 1173 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDSGAEPPSMTQLLRR

SEQ ID NO: 1174 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDSSGEPPSMTQLLRR

SEQ ID NO: 1175 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDSSSEPPSMTQLLRR

SEQ ID NO: 1176 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDSSAEPPSMTQLLRR

SEQ ID NO: 1177 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDSAGEPPSMTQLLRR

SEQ ID NO: 1178 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDSASEPPSMTQLLRR

SEQ ID NO: 1179 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDSAAEPPSMTQLLRR

SEQ ID NO: 1180 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDAGGEPPSMTQLLRR

SEQ ID NO: 1181 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDAGSEPPSMTQLLRR

SEQ ID NO: 1182 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDAGAEPPSMTQLLRR

SEQ ID NO: 1183 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDASGEPPSMTQLLRR

SEQ ID NO: 1184 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDASSEPPSMTQLLRR

SEQ ID NO: 1185 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDASAEPPSMTQLLRR

SEQ ID NO: 1186 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDAAGEPPSMTQLLRR

SEQ ID NO: 1187 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDAASEPPSMTQLLRR

SEQ ID NO: 1188 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKAGVSNKDIEKETAKDAAAEPPSMTQLLRR

SEQ ID NO: 1189 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDGGGEPPSMTQLLRR

SEQ ID NO: 1190 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDGGSEPPSMTQLLRR

SEQ ID NO: 1191 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDGGAEPPSMTQLLRR

SEQ ID NO: 1192 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDGSGEPPSMTQLLRR

SEQ ID NO: 1193 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDGSSEPPSMTQLLRR

SEQ ID NO: 1194 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDGSAEPPSMTQLLRR

SEQ ID NO: 1195 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDGAGEPPSMTQLLRR

SEQ ID NO: 1196 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDGASEPPSMTQLLRR

SEQ ID NO: 1197 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDGAAEPPSMTQLLRR

SEQ ID NO: 1198 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDSGGEPPSMTQLLRR

SEQ ID NO: 1199 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDSGSEPPSMTQLLRR

SEQ ID NO: 1200 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDSGAEPPSMTQLLRR

SEQ ID NO: 1201 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDSSGEPPSMTQLLRR

SEQ ID NO: 1202 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDSSSEPPSMTQLLRR

SEQ ID NO: 1203 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDSSAEPPSMTQLLRR

SEQ ID NO: 1204 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDSAGEPPSMTQLLRR

SEQ ID NO: 1205 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDSASEPPSMTQLLRR

SEQ ID NO: 1206 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDSAAEPPSMTQLLRR

SEQ ID NO: 1207 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDAGGEPPSMTQLLRR

SEQ ID NO: 1208 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDAGSEPPSMTQLLRR

SEQ ID NO: 1209 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDAGAEPPSMTQLLRR

SEQ ID NO: 1210 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDASGEPPSMTQLLRR

SEQ ID NO: 1211 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDASSEPPSMTQLLRR

SEQ ID NO: 1212 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDASAEPPSMTQLLRR

SEQ ID NO: 1213 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDAAGEPPSMTQLLRR

SEQ ID NO: 1214 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDAASEPPSMTQLLRR

SEQ ID NO: 1215 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKGGVSNKDIEKETAKDAAAEPPSMTQLLRR

SEQ ID NO: 1216 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDGGGEPPSMTQLLRR

SEQ ID NO: 1217 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDGGSEPPSMTQLLRR

SEQ ID NO: 1218 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDGGAEPPSMTQLLRR

SEQ ID NO: 1219 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDGSGEPPSMTQLLRR

SEQ ID NO: 1220 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDGSSEPPSMTQLLRR

SEQ ID NO: 1221 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDGSAEPPSMTQLLRR

SEQ ID NO: 1222 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDGAGEPPSMTQLLRR

SEQ ID NO: 1223 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDGASEPPSMTQLLRR

SEQ ID NO: 1224 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDGAAEPPSMTQLLRR

SEQ ID NO: 1225 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDSGGEPPSMTQLLRR

SEQ ID NO: 1226 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDSGSEPPSMTQLLRR

SEQ ID NO: 1227 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDSGAEPPSMTQLLRR

SEQ ID NO: 1228 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDSSGEPPSMTQLLRR

SEQ ID NO: 1229 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDSSSEPPSMTQLLRR

SEQ ID NO: 1230 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDSSAEPPSMTQLLRR

SEQ ID NO: 1231 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDSAGEPPSMTQLLRR

SEQ ID NO: 1232 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDSASEPPSMTQLLRR

SEQ ID NO: 1233 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDSAAEPPSMTQLLRR

SEQ ID NO: 1234 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDAGGEPPSMTQLLRR

SEQ ID NO: 1235 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDAGSEPPSMTQLLRR

SEQ ID NO: 1236 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDAGAEPPSMTQLLRR

SEQ ID NO: 1237 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDASGEPPSMTQLLRR

SEQ ID NO: 1238 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDASSEPPSMTQLLRR

SEQ ID NO: 1239 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDASAEPPSMTQLLRR

SEQ ID NO: 1240 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDAAGEPPSMTQLLRR

SEQ ID NO: 1241 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDAASEPPSMTQLLRR

SEQ ID NO: 1242 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKDGVSNKDIEKETAKDAAAEPPSMTQLLRR

SEQ ID NO: 1243 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDGGGEPPSMTQLLRR

SEQ ID NO: 1244 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDGGSEPPSMTQLLRR

SEQ ID NO: 1245 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDGGAEPPSMTQLLRR

SEQ ID NO: 1246 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDGSGEPPSMTQLLRR

SEQ ID NO: 1247 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDGSSEPPSMTQLLRR

SEQ ID NO: 1248 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDGSAEPPSMTQLLRR

SEQ ID NO: 1249 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDGAGEPPSMTQLLRR

SEQ ID NO: 1250 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDGASEPPSMTQLLRR

SEQ ID NO: 1251 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDGAAEPPSMTQLLRR

SEQ ID NO: 1252 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDSGGEPPSMTQLLRR

SEQ ID NO: 1253 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDSGSEPPSMTQLLRR

SEQ ID NO: 1254 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDSGAEPPSMTQLLRR

SEQ ID NO: 1255 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDSSGEPPSMTQLLRR

SEQ ID NO: 1256 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDSSSEPPSMTQLLRR

SEQ ID NO: 1257 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDSSAEPPSMTQLLRR

SEQ ID NO: 1258 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDSAGEPPSMTQLLRR

SEQ ID NO: 1259 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDSASEPPSMTQLLRR

SEQ ID NO: 1260 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDSAAEPPSMTQLLRR

SEQ ID NO: 1261 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDAGGEPPSMTQLLRR

SEQ ID NO: 1262 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDAGSEPPSMTQLLRR

SEQ ID NO: 1263 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDAGAEPPSMTQLLRR

SEQ ID NO: 1264 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDASGEPPSMTQLLRR

SEQ ID NO: 1265 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDASSEPPSMTQLLRR

SEQ ID NO: 1266 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDASAEPPSMTQLLRR

SEQ ID NO: 1267 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDAAGEPPSMTQLLRR

SEQ ID NO: 1268 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDAASEPPSMTQLLRR

SEQ ID NO: 1269 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKHGVSNKDIEKETAKDAAAEPPSMTQLLRR

SEQ ID NO: 1270 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDGGGEPPSMTQLLRR

SEQ ID NO: 1271 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDGGSEPPSMTQLLRR

SEQ ID NO: 1272 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDGGAEPPSMTQLLRR

SEQ ID NO: 1273 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDGSGEPPSMTQLLRR

SEQ ID NO: 1274 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDGSSEPPSMTQLLRR

SEQ ID NO: 1275 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDGSAEPPSMTQLLRR

SEQ ID NO: 1276 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDGAGEPPSMTQLLRR

SEQ ID NO: 1277 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDGASEPPSMTQLLRR

SEQ ID NO: 1278 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDGAAEPPSMTQLLRR

SEQ ID NO: 1279 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDSGGEPPSMTQLLRR

SEQ ID NO: 1280 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDSGSEPPSMTQLLRR

SEQ ID NO: 1281 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDSGAEPPSMTQLLRR

SEQ ID NO: 1282 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDSSGEPPSMTQLLRR

SEQ ID NO: 1283 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDSSSEPPSMTQLLRR

SEQ ID NO: 1284 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDSSAEPPSMTQLLRR

SEQ ID NO: 1285 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDSAGEPPSMTQLLRR

SEQ ID NO: 1286 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDSASEPPSMTQLLRR

SEQ ID NO: 1287 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDSAAEPPSMTQLLRR

SEQ ID NO: 1288 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDAGGEPPSMTQLLRR

SEQ ID NO: 1289 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDAGSEPPSMTQLLRR

SEQ ID NO: 1290 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDAGAEPPSMTQLLRR

SEQ ID NO: 1291 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDASGEPPSMTQLLRR

SEQ ID NO: 1292 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDASSEPPSMTQLLRR

SEQ ID NO: 1293 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDASAEPPSMTQLLRR

SEQ ID NO: 1294 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDAAGEPPSMTQLLRR

SEQ ID NO: 1295 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDAASEPPSMTQLLRR

SEQ ID NO: 1296 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKYGVSNKDIEKETAKDAAAEPPSMTQLLRR

SEQ ID NO: 1297 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDGGGEPPSMTQLLRR

SEQ ID NO: 1298 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDGGSEPPSMTQLLRR

SEQ ID NO: 1299 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDGGAEPPSMTQLLRR

SEQ ID NO: 1300 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDGSGEPPSMTQLLRR

SEQ ID NO: 1301 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDGSSEPPSMTQLLRR

SEQ ID NO: 1302 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDGSAEPPSMTQLLRR

SEQ ID NO: 1303 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDGAGEPPSMTQLLRR

SEQ ID NO: 1304 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDGASEPPSMTQLLRR

SEQ ID NO: 1305 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDGAAEPPSMTQLLRR

SEQ ID NO: 1306 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDSGGEPPSMTQLLRR

SEQ ID NO: 1307 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDSGSEPPSMTQLLRR

SEQ ID NO: 1308 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDSGAEPPSMTQLLRR

SEQ ID NO: 1309 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDSSGEPPSMTQLLRR

SEQ ID NO: 1310 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDSSSEPPSMTQLLRR

SEQ ID NO: 1311 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDSSAEPPSMTQLLRR

SEQ ID NO: 1312 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDSAGEPPSMTQLLRR

SEQ ID NO: 1313 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDSASEPPSMTQLLRR

SEQ ID NO: 1314 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDSAAEPPSMTQLLRR

SEQ ID NO: 1315 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDAGGEPPSMTQLLRR

SEQ ID NO: 1316 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDAGSEPPSMTQLLRR

SEQ ID NO: 1317 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDAGAEPPSMTQLLRR

SEQ ID NO: 1318 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDASGEPPSMTQLLRR

SEQ ID NO: 1319 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDASSEPPSMTQLLRR

SEQ ID NO: 1320 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDASAEPPSMTQLLRR

SEQ ID NO: 1321 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDAAGEPPSMTQLLRR

SEQ ID NO: 1322 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDAASEPPSMTQLLRR

SEQ ID NO: 1323 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKKGVSNKDIEKETAKDAAAEPPSMTQLLRR

SEQ ID NO: 1324 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDGGGEPPSMTQLLRR

SEQ ID NO: 1325 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDGGSEPPSMTQLLRR

SEQ ID NO: 1326 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDGGAEPPSMTQLLRR

SEQ ID NO: 1327 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDGSGEPPSMTQLLRR

SEQ ID NO: 1328 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDGSSEPPSMTQLLRR

SEQ ID NO: 1329 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDGSAEPPSMTQLLRR

SEQ ID NO: 1330 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDGAGEPPSMTQLLRR

SEQ ID NO: 1331 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDGASEPPSMTQLLRR

SEQ ID NO: 1332 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDGAAEPPSMTQLLRR

SEQ ID NO: 1333 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDSGGEPPSMTQLLRR

SEQ ID NO: 1334 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDSGSEPPSMTQLLRR

SEQ ID NO: 1335 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDSGAEPPSMTQLLRR

SEQ ID NO: 1336 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDSSGEPPSMTQLLRR

SEQ ID NO: 1337 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDSSSEPPSMTQLLRR

SEQ ID NO: 1338 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDSSAEPPSMTQLLRR

SEQ ID NO: 1339 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDSAGEPPSMTQLLRR

SEQ ID NO: 1340 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDSASEPPSMTQLLRR

SEQ ID NO: 1341 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDSAAEPPSMTQLLRR

SEQ ID NO: 1342 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDAGGEPPSMTQLLRR

SEQ ID NO: 1343 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDAGSEPPSMTQLLRR

SEQ ID NO: 1344 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDAGAEPPSMTQLLRR

SEQ ID NO: 1345 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDASGEPPSMTQLLRR

SEQ ID NO: 1346 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDASSEPPSMTQLLRR

SEQ ID NO: 1347 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDASAEPPSMTQLLRR

SEQ ID NO: 1348 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDAAGEPPSMTQLLRR

SEQ ID NO: 1349 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDAASEPPSMTQLLRR

SEQ ID NO: 1350 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKNGVSNKDIEKETAKDAAAEPPSMTQLLRR

SEQ ID NO: 1351 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDGGGEPPSMTQLLRR

SEQ ID NO: 1352 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDGGSEPPSMTQLLRR

SEQ ID NO: 1353 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDGGAEPPSMTQLLRR

SEQ ID NO: 1354 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDGSGEPPSMTQLLRR

SEQ ID NO: 1355 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDGSSEPPSMTQLLRR

SEQ ID NO: 1356 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDGSAEPPSMTQLLRR

SEQ ID NO: 1357 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDGAGEPPSMTQLLRR

SEQ ID NO: 1358 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDGASEPPSMTQLLRR

SEQ ID NO: 1359 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDGAAEPPSMTQLLRR

SEQ ID NO: 1360 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDSGGEPPSMTQLLRR

SEQ ID NO: 1361 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDSGSEPPSMTQLLRR

SEQ ID NO: 1362 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDSGAEPPSMTQLLRR

SEQ ID NO: 1363 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDSSGEPPSMTQLLRR

SEQ ID NO: 1364 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDSSSEPPSMTQLLRR

SEQ ID NO: 1365 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDSSAEPPSMTQLLRR

SEQ ID NO: 1366 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDSAGEPPSMTQLLRR

SEQ ID NO: 1367 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDSASEPPSMTQLLRR

SEQ ID NO: 1368 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDSAAEPPSMTQLLRR

SEQ ID NO: 1369 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDAGGEPPSMTQLLRR

SEQ ID NO: 1370 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDAGSEPPSMTQLLRR

SEQ ID NO: 1371 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDAGAEPPSMTQLLRR

SEQ ID NO: 1372 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDASGEPPSMTQLLRR

SEQ ID NO: 1373 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDASSEPPSMTQLLRR

SEQ ID NO: 1374 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDASAEPPSMTQLLRR

SEQ ID NO: 1375 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDAAGEPPSMTQLLRR

SEQ ID NO: 1376 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDAASEPPSMTQLLRR

SEQ ID NO: 1377 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDDFGLRGLLHLENASYGIEPLQNSSHFEHIIYRMDDVYKEPLKMGVSNKDIEKETAKDAAAEPPSMTQLLRR

SEQ ID NO: 1378 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDGGGEPPSMTQLLRR

SEQ ID NO: 1379 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDGGSEPPSMTQLLRR

SEQ ID NO: 1380 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDGGAEPPSMTQLLRR

SEQ ID NO: 1381 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDGSGEPPSMTQLLRR

SEQ ID NO: 1382 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDGSSEPPSMTQLLRR

SEQ ID NO: 1383 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDGSAEPPSMTQLLRR

SEQ ID NO: 1384 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDGAGEPPSMTQLLRR

SEQ ID NO: 1385 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDGASEPPSMTQLLRR

SEQ ID NO: 1386 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDGAAEPPSMTQLLRR

SEQ ID NO: 1387 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDSGGEPPSMTQLLRR

SEQ ID NO: 1388 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDSGSEPPSMTQLLRR

SEQ ID NO: 1389 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDSGAEPPSMTQLLRR

SEQ ID NO: 1390 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDSSGEPPSMTQLLRR

SEQ ID NO: 1391 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDSSSEPPSMTQLLRR

SEQ ID NO: 1392 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDSSAEPPSMTQLLRR

SEQ ID NO: 1393 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDSAGEPPSMTQLLRR

SEQ ID NO: 1394 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDSASEPPSMTQLLRR

SEQ ID NO: 1395 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDSAAEPPSMTQLLRR

SEQ ID NO: 1396 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDAGGEPPSMTQLLRR

SEQ ID NO: 1397 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDAGSEPPSMTQLLRR

SEQ ID NO: 1398 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDAGAEPPSMTQLLRR

SEQ ID NO: 1399 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDASGEPPSMTQLLRR

SEQ ID NO: 1400 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDASSEPPSMTQLLRR

SEQ ID NO: 1401 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDASAEPPSMTQLLRR

SEQ ID NO: 1402 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDAAGEPPSMTQLLRR

SEQ ID NO: 1403 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDAASEPPSMTQLLRR

SEQ ID NO: 1404 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKCGVSNKDIEKETAKDAAAEPPSMTQLLRR

SEQ ID NO: 1405 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDGGGEPPSMTQLLRR

SEQ ID NO: 1406 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDGGSEPPSMTQLLRR

SEQ ID NO: 1407 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDGGAEPPSMTQLLRR

SEQ ID NO: 1408 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDGSGEPPSMTQLLRR

SEQ ID NO: 1409 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDGSSEPPSMTQLLRR

SEQ ID NO: 1410 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDGSAEPPSMTQLLRR

SEQ ID NO: 1411 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDGAGEPPSMTQLLRR

SEQ ID NO: 1412 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDGASEPPSMTQLLRR

SEQ ID NO: 1413 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDGAAEPPSMTQLLRR

SEQ ID NO: 1414 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDSGGEPPSMTQLLRR

SEQ ID NO: 1415 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDSGSEPPSMTQLLRR

SEQ ID NO: 1416 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDSGAEPPSMTQLLRR

SEQ ID NO: 1417 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDSSGEPPSMTQLLRR

SEQ ID NO: 1418 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDSSSEPPSMTQLLRR

SEQ ID NO: 1419 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDSSAEPPSMTQLLRR

SEQ ID NO: 1420 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDSAGEPPSMTQLLRR

SEQ ID NO: 1421 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDSASEPPSMTQLLRR

SEQ ID NO: 1422 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDSAAEPPSMTQLLRR

SEQ ID NO: 1423 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDAGGEPPSMTQLLRR

SEQ ID NO: 1424 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDAGSEPPSMTQLLRR

SEQ ID NO: 1425 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDAGAEPPSMTQLLRR

SEQ ID NO: 1426 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDASGEPPSMTQLLRR

SEQ ID NO: 1427 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDASSEPPSMTQLLRR

SEQ ID NO: 1428 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDASAEPPSMTQLLRR

SEQ ID NO: 1429 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDAAGEPPSMTQLLRR

SEQ ID NO: 1430 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDAASEPPSMTQLLRR

SEQ ID NO: 1431 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKSGVSNKDIEKETAKDAAAEPPSMTQLLRR

SEQ ID NO: 1432 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDGGGEPPSMTQLLRR

SEQ ID NO: 1433 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDGGSEPPSMTQLLRR

SEQ ID NO: 1434 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDGGAEPPSMTQLLRR

SEQ ID NO: 1435 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDGSGEPPSMTQLLRR

SEQ ID NO: 1436 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDGSSEPPSMTQLLRR

SEQ ID NO: 1437 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDGSAEPPSMTQLLRR

SEQ ID NO: 1438 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDGAGEPPSMTQLLRR

SEQ ID NO: 1439 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDGASEPPSMTQLLRR

SEQ ID NO: 1440 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDGAAEPPSMTQLLRR

SEQ ID NO: 1441 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDSGGEPPSMTQLLRR

SEQ ID NO: 1442 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDSGSEPPSMTQLLRR

SEQ ID NO: 1443 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDSGAEPPSMTQLLRR

SEQ ID NO: 1444 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDSSGEPPSMTQLLRR

SEQ ID NO: 1445 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDSSSEPPSMTQLLRR

SEQ ID NO: 1446 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDSSAEPPSMTQLLRR

SEQ ID NO: 1447 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDSAGEPPSMTQLLRR

SEQ ID NO: 1448 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDSASEPPSMTQLLRR

SEQ ID NO: 1449 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDSAAEPPSMTQLLRR

SEQ ID NO: 1450 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDAGGEPPSMTQLLRR

SEQ ID NO: 1451 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDAGSEPPSMTQLLRR

SEQ ID NO: 1452 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDAGAEPPSMTQLLRR

SEQ ID NO: 1453 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDASGEPPSMTQLLRR

SEQ ID NO: 1454 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDASSEPPSMTQLLRR

SEQ ID NO: 1455 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDASAEPPSMTQLLRR

SEQ ID NO: 1456 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDAAGEPPSMTQLLRR

SEQ ID NO: 1457 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDAASEPPSMTQLLRR

SEQ ID NO: 1458 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKAGVSNKDIEKETAKDAAAEPPSMTQLLRR

SEQ ID NO: 1459 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDGGGEPPSMTQLLRR

SEQ ID NO: 1460 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDGGSEPPSMTQLLRR

SEQ ID NO: 1461 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDGGAEPPSMTQLLRR

SEQ ID NO: 1462 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDGSGEPPSMTQLLRR

SEQ ID NO: 1463 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDGSSEPPSMTQLLRR

SEQ ID NO: 1464 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDGSAEPPSMTQLLRR

SEQ ID NO: 1465 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDGAGEPPSMTQLLRR

SEQ ID NO: 1466 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDGASEPPSMTQLLRR

SEQ ID NO: 1467 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDGAAEPPSMTQLLRR

SEQ ID NO: 1468 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDSGGEPPSMTQLLRR

SEQ ID NO: 1469 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDSGSEPPSMTQLLRR

SEQ ID NO: 1470 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDSGAEPPSMTQLLRR

SEQ ID NO: 1471 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDSSGEPPSMTQLLRR

SEQ ID NO: 1472 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDSSSEPPSMTQLLRR

SEQ ID NO: 1473 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDSSAEPPSMTQLLRR

SEQ ID NO: 1474 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDSAGEPPSMTQLLRR

SEQ ID NO: 1475 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDSASEPPSMTQLLRR

SEQ ID NO: 1476 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDSAAEPPSMTQLLRR

SEQ ID NO: 1477 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDAGGEPPSMTQLLRR

SEQ ID NO: 1478 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDAGSEPPSMTQLLRR

SEQ ID NO: 1479 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDAGAEPPSMTQLLRR

SEQ ID NO: 1480 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDASGEPPSMTQLLRR

SEQ ID NO: 1481 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDASSEPPSMTQLLRR

SEQ ID NO: 1482 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDASAEPPSMTQLLRR

SEQ ID NO: 1483 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDAAGEPPSMTQLLRR

SEQ ID NO: 1484 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDAASEPPSMTQLLRR

SEQ ID NO: 1485 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKGGVSNKDIEKETAKDAAAEPPSMTQLLRR

SEQ ID NO: 1486 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDGGGEPPSMTQLLRR

SEQ ID NO: 1487 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDGGSEPPSMTQLLRR

SEQ ID NO: 1488 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDGGAEPPSMTQLLRR

SEQ ID NO: 1489 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDGSGEPPSMTQLLRR

SEQ ID NO: 1490 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDGSSEPPSMTQLLRR

SEQ ID NO: 1491 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDGSAEPPSMTQLLRR

SEQ ID NO: 1492 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDGAGEPPSMTQLLRR

SEQ ID NO: 1493 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDGASEPPSMTQLLRR

SEQ ID NO: 1494 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDGAAEPPSMTQLLRR

SEQ ID NO: 1495 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDSGGEPPSMTQLLRR

SEQ ID NO: 1496 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDSGSEPPSMTQLLRR

SEQ ID NO: 1497 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDSGAEPPSMTQLLRR

SEQ ID NO: 1498 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDSSGEPPSMTQLLRR

SEQ ID NO: 1499 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDSSSEPPSMTQLLRR

SEQ ID NO: 1500 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDSSAEPPSMTQLLRR

SEQ ID NO: 1501 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDSAGEPPSMTQLLRR

SEQ ID NO: 1502 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDSASEPPSMTQLLRR

SEQ ID NO: 1503 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDSAAEPPSMTQLLRR

SEQ ID NO: 1504 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDAGGEPPSMTQLLRR

SEQ ID NO: 1505 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDAGSEPPSMTQLLRR

SEQ ID NO: 1506 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDAGAEPPSMTQLLRR

SEQ ID NO: 1507 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDASGEPPSMTQLLRR

SEQ ID NO: 1508 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDASSEPPSMTQLLRR

SEQ ID NO: 1509 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDASAEPPSMTQLLRR

SEQ ID NO: 1510 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDAAGEPPSMTQLLRR

SEQ ID NO: 1511 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDAASEPPSMTQLLRR

SEQ ID NO: 1512 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKDGVSNKDIEKETAKDAAAEPPSMTQLLRR

SEQ ID NO: 1513 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDGGGEPPSMTQLLRR

SEQ ID NO: 1514 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDGGSEPPSMTQLLRR

SEQ ID NO: 1515 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDGGAEPPSMTQLLRR

SEQ ID NO: 1516 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDGSGEPPSMTQLLRR

SEQ ID NO: 1517 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDGSSEPPSMTQLLRR

SEQ ID NO: 1518 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDGSAEPPSMTQLLRR

SEQ ID NO: 1519 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDGAGEPPSMTQLLRR

SEQ ID NO: 1520 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDGASEPPSMTQLLRR

SEQ ID NO: 1521 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDGAAEPPSMTQLLRR

SEQ ID NO: 1522 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDSGGEPPSMTQLLRR

SEQ ID NO: 1523 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDSGSEPPSMTQLLRR

SEQ ID NO: 1524 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDSGAEPPSMTQLLRR

SEQ ID NO: 1525 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDSSGEPPSMTQLLRR

SEQ ID NO: 1526 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDSSSEPPSMTQLLRR

SEQ ID NO: 1527 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDSSAEPPSMTQLLRR

SEQ ID NO: 1528 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDSAGEPPSMTQLLRR

SEQ ID NO: 1529 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDSASEPPSMTQLLRR

SEQ ID NO: 1530 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDSAAEPPSMTQLLRR

SEQ ID NO: 1531 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDAGGEPPSMTQLLRR

SEQ ID NO: 1532 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDAGSEPPSMTQLLRR

SEQ ID NO: 1533 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDAGAEPPSMTQLLRR

SEQ ID NO: 1534 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDASGEPPSMTQLLRR

SEQ ID NO: 1535 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDASSEPPSMTQLLRR

SEQ ID NO: 1536 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDASAEPPSMTQLLRR

SEQ ID NO: 1537 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDAAGEPPSMTQLLRR

SEQ ID NO: 1538 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDAASEPPSMTQLLRR

SEQ ID NO: 1539 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKHGVSNKDIEKETAKDAAAEPPSMTQLLRR

SEQ ID NO: 1540 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDGGGEPPSMTQLLRR

SEQ ID NO: 1541 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDGGSEPPSMTQLLRR

SEQ ID NO: 1542 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDGGAEPPSMTQLLRR

SEQ ID NO: 1543 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDGSGEPPSMTQLLRR

SEQ ID NO: 1544 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDGSSEPPSMTQLLRR

SEQ ID NO: 1545 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDGSAEPPSMTQLLRR

SEQ ID NO: 1546 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDGAGEPPSMTQLLRR

SEQ ID NO: 1547 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDGASEPPSMTQLLRR

SEQ ID NO: 1548 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDGAAEPPSMTQLLRR

SEQ ID NO: 1549 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDSGGEPPSMTQLLRR

SEQ ID NO: 1550 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDSGSEPPSMTQLLRR

SEQ ID NO: 1551 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDSGAEPPSMTQLLRR

SEQ ID NO: 1552 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDSSGEPPSMTQLLRR

SEQ ID NO: 1553 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDSSSEPPSMTQLLRR

SEQ ID NO: 1554 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDSSAEPPSMTQLLRR

SEQ ID NO: 1555 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDSAGEPPSMTQLLRR

SEQ ID NO: 1556 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDSASEPPSMTQLLRR

SEQ ID NO: 1557 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDSAAEPPSMTQLLRR

SEQ ID NO: 1558 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDAGGEPPSMTQLLRR

SEQ ID NO: 1559 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDAGSEPPSMTQLLRR

SEQ ID NO: 1560 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDAGAEPPSMTQLLRR

SEQ ID NO: 1561 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDASGEPPSMTQLLRR

SEQ ID NO: 1562 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDASSEPPSMTQLLRR

SEQ ID NO: 1563 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDASAEPPSMTQLLRR

SEQ ID NO: 1564 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDAAGEPPSMTQLLRR

SEQ ID NO: 1565 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDAASEPPSMTQLLRR

SEQ ID NO: 1566 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKYGVSNKDIEKETAKDAAAEPPSMTQLLRR

SEQ ID NO: 1567 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDGGGEPPSMTQLLRR

SEQ ID NO: 1568 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDGGSEPPSMTQLLRR

SEQ ID NO: 1569 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDGGAEPPSMTQLLRR

SEQ ID NO: 1570 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDGSGEPPSMTQLLRR

SEQ ID NO: 1571 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDGSSEPPSMTQLLRR

SEQ ID NO: 1572 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDGSAEPPSMTQLLRR

SEQ ID NO: 1573 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDGAGEPPSMTQLLRR

SEQ ID NO: 1574 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDGASEPPSMTQLLRR

SEQ ID NO: 1575 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDGAAEPPSMTQLLRR

SEQ ID NO: 1576 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDSGGEPPSMTQLLRR

SEQ ID NO: 1577 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDSGSEPPSMTQLLRR

SEQ ID NO: 1578 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDSGAEPPSMTQLLRR

SEQ ID NO: 1579 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDSSGEPPSMTQLLRR

SEQ ID NO: 1580 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDSSSEPPSMTQLLRR

SEQ ID NO: 1581 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDSSAEPPSMTQLLRR

SEQ ID NO: 1582 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDSAGEPPSMTQLLRR

SEQ ID NO: 1583 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDSASEPPSMTQLLRR

SEQ ID NO: 1584 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDSAAEPPSMTQLLRR

SEQ ID NO: 1585 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDAGGEPPSMTQLLRR

SEQ ID NO: 1586 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDAGSEPPSMTQLLRR

SEQ ID NO: 1587 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDAGAEPPSMTQLLRR

SEQ ID NO: 1588 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDASGEPPSMTQLLRR

SEQ ID NO: 1589 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDASSEPPSMTQLLRR

SEQ ID NO: 1590 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDASAEPPSMTQLLRR

SEQ ID NO: 1591 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDAAGEPPSMTQLLRR

SEQ ID NO: 1592 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDAASEPPSMTQLLRR

SEQ ID NO: 1593 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKKGVSNKDIEKETAKDAAAEPPSMTQLLRR

SEQ ID NO: 1594 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDGGGEPPSMTQLLRR

SEQ ID NO: 1595 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDGGSEPPSMTQLLRR

SEQ ID NO: 1596 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDGGAEPPSMTQLLRR

SEQ ID NO: 1597 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDGSGEPPSMTQLLRR

SEQ ID NO: 1598 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDGSSEPPSMTQLLRR

SEQ ID NO: 1599 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDGSAEPPSMTQLLRR

SEQ ID NO: 1600 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDGAGEPPSMTQLLRR

SEQ ID NO: 1601 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDGASEPPSMTQLLRR

SEQ ID NO: 1602 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDGAAEPPSMTQLLRR

SEQ ID NO: 1603 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDSGGEPPSMTQLLRR

SEQ ID NO: 1604 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDSGSEPPSMTQLLRR

SEQ ID NO: 1605 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDSGAEPPSMTQLLRR

SEQ ID NO: 1606 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDSSGEPPSMTQLLRR

SEQ ID NO: 1607 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDSSSEPPSMTQLLRR

SEQ ID NO: 1608 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDSSAEPPSMTQLLRR

SEQ ID NO: 1609 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDSAGEPPSMTQLLRR

SEQ ID NO: 1610 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDSASEPPSMTQLLRR

SEQ ID NO: 1611 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDSAAEPPSMTQLLRR

SEQ ID NO: 1612 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDAGGEPPSMTQLLRR

SEQ ID NO: 1613 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDAGSEPPSMTQLLRR

SEQ ID NO: 1614 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDAGAEPPSMTQLLRR

SEQ ID NO: 1615 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDASGEPPSMTQLLRR

SEQ ID NO: 1616 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDASSEPPSMTQLLRR

SEQ ID NO: 1617 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDASAEPPSMTQLLRR

SEQ ID NO: 1618 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDAAGEPPSMTQLLRR

SEQ ID NO: 1619 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDAASEPPSMTQLLRR

SEQ ID NO: 1620 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKNGVSNKDIEKETAKDAAAEPPSMTQLLRR

SEQ ID NO: 1621 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDGGGEPPSMTQLLRR

SEQ ID NO: 1622 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDGGSEPPSMTQLLRR

SEQ ID NO: 1623 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDGGAEPPSMTQLLRR

SEQ ID NO: 1624 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDGSGEPPSMTQLLRR

SEQ ID NO: 1625 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDGSSEPPSMTQLLRR

SEQ ID NO: 1626 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDGSAEPPSMTQLLRR

SEQ ID NO: 1627 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDGAGEPPSMTQLLRR

SEQ ID NO: 1628 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDGASEPPSMTQLLRR

SEQ ID NO: 1629 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDGAAEPPSMTQLLRR

SEQ ID NO: 1630 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDSGGEPPSMTQLLRR

SEQ ID NO: 1631 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDSGSEPPSMTQLLRR

SEQ ID NO: 1632 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDSGAEPPSMTQLLRR

SEQ ID NO: 1633 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDSSGEPPSMTQLLRR

SEQ ID NO: 1634 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDSSSEPPSMTQLLRR

SEQ ID NO: 1635 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDSSAEPPSMTQLLRR

SEQ ID NO: 1636 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDSAGEPPSMTQLLRR

SEQ ID NO: 1637 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDSASEPPSMTQLLRR

SEQ ID NO: 1638 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDSAAEPPSMTQLLRR

SEQ ID NO: 1639 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDAGGEPPSMTQLLRR

SEQ ID NO: 1640 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDAGSEPPSMTQLLRR

SEQ ID NO: 1641 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDAGAEPPSMTQLLRR

SEQ ID NO: 1642 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDASGEPPSMTQLLRR

SEQ ID NO: 1643 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDASSEPPSMTQLLRR

SEQ ID NO: 1644 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDASAEPPSMTQLLRR

SEQ ID NO: 1645 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDAAGEPPSMTQLLRR

SEQ ID NO: 1646 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDAASEPPSMTQLLRR

SEQ ID NO: 1647 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDHFGLRGLLHLENASYGIEPLQNSSHFEHIIYRMDDVYKEPLKMGVSNKDIEKETAKDAAAEPPSMTQLLRR

SEQ ID NO: 1648 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDGGGEPPSMTQLLRR

SEQ ID NO: 1649 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDGGSEPPSMTQLLRR

SEQ ID NO: 1650 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDGGAEPPSMTQLLRR

SEQ ID NO: 1651 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDGSGEPPSMTQLLRR

SEQ ID NO: 1652 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDGSSEPPSMTQLLRR

SEQ ID NO: 1653 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDGSAEPPSMTQLLRR

SEQ ID NO: 1654 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDGAGEPPSMTQLLRR

SEQ ID NO: 1655 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDGASEPPSMTQLLRR

SEQ ID NO: 1656 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDGAAEPPSMTQLLRR

SEQ ID NO: 1657 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDSGGEPPSMTQLLRR

SEQ ID NO: 1658 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDSGSEPPSMTQLLRR

SEQ ID NO: 1659 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDSGAEPPSMTQLLRR

SEQ ID NO: 1660 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDSSGEPPSMTQLLRR

SEQ ID NO: 1661 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDSSSEPPSMTQLLRR

SEQ ID NO: 1662 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDSSAEPPSMTQLLRR

SEQ ID NO: 1663 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDSAGEPPSMTQLLRR

SEQ ID NO: 1664 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDSASEPPSMTQLLRR

SEQ ID NO: 1665 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDSAAEPPSMTQLLRR

SEQ ID NO: 1666 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDAGGEPPSMTQLLRR

SEQ ID NO: 1667 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDAGSEPPSMTQLLRR

SEQ ID NO: 1668 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDAGAEPPSMTQLLRR

SEQ ID NO: 1669 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDASGEPPSMTQLLRR

SEQ ID NO: 1670 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDASSEPPSMTQLLRR

SEQ ID NO: 1671 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDASAEPPSMTQLLRR

SEQ ID NO: 1672 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDAAGEPPSMTQLLRR

SEQ ID NO: 1673 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDAASEPPSMTQLLRR

SEQ ID NO: 1674 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKCGVSNKDIEKETAKDAAAEPPSMTQLLRR

SEQ ID NO: 1675 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDGGGEPPSMTQLLRR

SEQ ID NO: 1676 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDGGSEPPSMTQLLRR

SEQ ID NO: 1677 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDGGAEPPSMTQLLRR

SEQ ID NO: 1678 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDGSGEPPSMTQLLRR

SEQ ID NO: 1679 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDGSSEPPSMTQLLRR

SEQ ID NO: 1680 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDGSAEPPSMTQLLRR

SEQ ID NO: 1681 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDGAGEPPSMTQLLRR

SEQ ID NO: 1682 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDGASEPPSMTQLLRR

SEQ ID NO: 1683 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDGAAEPPSMTQLLRR

SEQ ID NO: 1684 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDSGGEPPSMTQLLRR

SEQ ID NO: 1685 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDSGSEPPSMTQLLRR

SEQ ID NO: 1686 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDSGAEPPSMTQLLRR

SEQ ID NO: 1687 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDSSGEPPSMTQLLRR

SEQ ID NO: 1688 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDSSSEPPSMTQLLRR

SEQ ID NO: 1689 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDSSAEPPSMTQLLRR

SEQ ID NO: 1690 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDSAGEPPSMTQLLRR

SEQ ID NO: 1691 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDSASEPPSMTQLLRR

SEQ ID NO: 1692 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDSAAEPPSMTQLLRR

SEQ ID NO: 1693 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDAGGEPPSMTQLLRR

SEQ ID NO: 1694 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDAGSEPPSMTQLLRR

SEQ ID NO: 1695 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDAGAEPPSMTQLLRR

SEQ ID NO: 1696 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDASGEPPSMTQLLRR

SEQ ID NO: 1697 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDASSEPPSMTQLLRR

SEQ ID NO: 1698 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDASAEPPSMTQLLRR

SEQ ID NO: 1699 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDAAGEPPSMTQLLRR

SEQ ID NO: 1700 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDAASEPPSMTQLLRR

SEQ ID NO: 1701 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKSGVSNKDIEKETAKDAAAEPPSMTQLLRR

SEQ ID NO: 1702 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDGGGEPPSMTQLLRR

SEQ ID NO: 1703 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDGGSEPPSMTQLLRR

SEQ ID NO: 1704 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDGGAEPPSMTQLLRR

SEQ ID NO: 1705 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDGSGEPPSMTQLLRR

SEQ ID NO: 1706 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDGSSEPPSMTQLLRR

SEQ ID NO: 1707 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDGSAEPPSMTQLLRR

SEQ ID NO: 1708 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDGAGEPPSMTQLLRR

SEQ ID NO: 1709 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDGASEPPSMTQLLRR

SEQ ID NO: 1710 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDGAAEPPSMTQLLRR

SEQ ID NO: 1711 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDSGGEPPSMTQLLRR

SEQ ID NO: 1712 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDSGSEPPSMTQLLRR

SEQ ID NO: 1713 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDSGAEPPSMTQLLRR

SEQ ID NO: 1714 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDSSGEPPSMTQLLRR

SEQ ID NO: 1715 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDSSSEPPSMTQLLRR

SEQ ID NO: 1716 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDSSAEPPSMTQLLRR

SEQ ID NO: 1717 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDSAGEPPSMTQLLRR

SEQ ID NO: 1718 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDSASEPPSMTQLLRR

SEQ ID NO: 1719 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDSAAEPPSMTQLLRR

SEQ ID NO: 1720 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDAGGEPPSMTQLLRR

SEQ ID NO: 1721 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDAGSEPPSMTQLLRR

SEQ ID NO: 1722 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDAGAEPPSMTQLLRR

SEQ ID NO: 1723 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDASGEPPSMTQLLRR

SEQ ID NO: 1724 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDASSEPPSMTQLLRR

SEQ ID NO: 1725 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDASAEPPSMTQLLRR

SEQ ID NO: 1726 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDAAGEPPSMTQLLRR

SEQ ID NO: 1727 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDAASEPPSMTQLLRR

SEQ ID NO: 1728 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKAGVSNKDIEKETAKDAAAEPPSMTQLLRR

SEQ ID NO: 1729 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDGGGEPPSMTQLLRR

SEQ ID NO: 1730 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDGGSEPPSMTQLLRR

SEQ ID NO: 1731 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDGGAEPPSMTQLLRR

SEQ ID NO: 1732 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDGSGEPPSMTQLLRR

SEQ ID NO: 1733 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDGSSEPPSMTQLLRR

SEQ ID NO: 1734 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDGSAEPPSMTQLLRR

SEQ ID NO: 1735 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDGAGEPPSMTQLLRR

SEQ ID NO: 1736 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDGASEPPSMTQLLRR

SEQ ID NO: 1737 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDGAAEPPSMTQLLRR

SEQ ID NO: 1738 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDSGGEPPSMTQLLRR

SEQ ID NO: 1739 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDSGSEPPSMTQLLRR

SEQ ID NO: 1740 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDSGAEPPSMTQLLRR

SEQ ID NO: 1741 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDSSGEPPSMTQLLRR

SEQ ID NO: 1742 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDSSSEPPSMTQLLRR

SEQ ID NO: 1743 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDSSAEPPSMTQLLRR

SEQ ID NO: 1744 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDSAGEPPSMTQLLRR

SEQ ID NO: 1745 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDSASEPPSMTQLLRR

SEQ ID NO: 1746 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDSAAEPPSMTQLLRR

SEQ ID NO: 1747 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDAGGEPPSMTQLLRR

SEQ ID NO: 1748 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDAGSEPPSMTQLLRR

SEQ ID NO: 1749 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDAGAEPPSMTQLLRR

SEQ ID NO: 1750 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDASGEPPSMTQLLRR

SEQ ID NO: 1751 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDASSEPPSMTQLLRR

SEQ ID NO: 1752 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDASAEPPSMTQLLRR

SEQ ID NO: 1753 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDAAGEPPSMTQLLRR

SEQ ID NO: 1754 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDAASEPPSMTQLLRR

SEQ ID NO: 1755 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKGGVSNKDIEKETAKDAAAEPPSMTQLLRR

SEQ ID NO: 1756 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDGGGEPPSMTQLLRR

SEQ ID NO: 1757 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDGGSEPPSMTQLLRR

SEQ ID NO: 1758 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDGGAEPPSMTQLLRR

SEQ ID NO: 1759 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDGSGEPPSMTQLLRR

SEQ ID NO: 1760 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDGSSEPPSMTQLLRR

SEQ ID NO: 1761 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDGSAEPPSMTQLLRR

SEQ ID NO: 1762 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDGAGEPPSMTQLLRR

SEQ ID NO: 1763 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDGASEPPSMTQLLRR

SEQ ID NO: 1764 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDGAAEPPSMTQLLRR

SEQ ID NO: 1765 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDSGGEPPSMTQLLRR

SEQ ID NO: 1766 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDSGSEPPSMTQLLRR

SEQ ID NO: 1767 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDSGAEPPSMTQLLRR

SEQ ID NO: 1768 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDSSGEPPSMTQLLRR

SEQ ID NO: 1769 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDSSSEPPSMTQLLRR

SEQ ID NO: 1770 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDSSAEPPSMTQLLRR

SEQ ID NO: 1771 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDSAGEPPSMTQLLRR

SEQ ID NO: 1772 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDSASEPPSMTQLLRR

SEQ ID NO: 1773 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDSAAEPPSMTQLLRR

SEQ ID NO: 1774 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDAGGEPPSMTQLLRR

SEQ ID NO: 1775 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDAGSEPPSMTQLLRR

SEQ ID NO: 1776 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDAGAEPPSMTQLLRR

SEQ ID NO: 1777 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDASGEPPSMTQLLRR

SEQ ID NO: 1778 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDASSEPPSMTQLLRR

SEQ ID NO: 1779 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDASAEPPSMTQLLRR

SEQ ID NO: 1780 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDAAGEPPSMTQLLRR

SEQ ID NO: 1781 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDAASEPPSMTQLLRR

SEQ ID NO: 1782 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKDGVSNKDIEKETAKDAAAEPPSMTQLLRR

SEQ ID NO: 1783 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDGGGEPPSMTQLLRR

SEQ ID NO: 1784 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDGGSEPPSMTQLLRR

SEQ ID NO: 1785 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDGGAEPPSMTQLLRR

SEQ ID NO: 1786 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDGSGEPPSMTQLLRR

SEQ ID NO: 1787 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDGSSEPPSMTQLLRR

SEQ ID NO: 1788 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDGSAEPPSMTQLLRR

SEQ ID NO: 1789 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDGAGEPPSMTQLLRR

SEQ ID NO: 1790 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDGASEPPSMTQLLRR

SEQ ID NO: 1791 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDGAAEPPSMTQLLRR

SEQ ID NO: 1792 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDSGGEPPSMTQLLRR

SEQ ID NO: 1793 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDSGSEPPSMTQLLRR

SEQ ID NO: 1794 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDSGAEPPSMTQLLRR

SEQ ID NO: 1795 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDSSGEPPSMTQLLRR

SEQ ID NO: 1796 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDSSSEPPSMTQLLRR

SEQ ID NO: 1797 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDSSAEPPSMTQLLRR

SEQ ID NO: 1798 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDSAGEPPSMTQLLRR

SEQ ID NO: 1799 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDSASEPPSMTQLLRR

SEQ ID NO: 1800 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDSAAEPPSMTQLLRR

SEQ ID NO: 1801 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDAGGEPPSMTQLLRR

SEQ ID NO: 1802 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDAGSEPPSMTQLLRR

SEQ ID NO: 1803 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDAGAEPPSMTQLLRR

SEQ ID NO: 1804 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDASGEPPSMTQLLRR

SEQ ID NO: 1805 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDASSEPPSMTQLLRR

SEQ ID NO: 1806 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDASAEPPSMTQLLRR

SEQ ID NO: 1807 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDAAGEPPSMTQLLRR

SEQ ID NO: 1808 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDAASEPPSMTQLLRR

SEQ ID NO: 1809 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKHGVSNKDIEKETAKDAAAEPPSMTQLLRR

SEQ ID NO: 1810 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDGGGEPPSMTQLLRR

SEQ ID NO: 1811 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDGGSEPPSMTQLLRR

SEQ ID NO: 1812 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDGGAEPPSMTQLLRR

SEQ ID NO: 1813 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDGSGEPPSMTQLLRR

SEQ ID NO: 1814 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDGSSEPPSMTQLLRR

SEQ ID NO: 1815 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDGSAEPPSMTQLLRR

SEQ ID NO: 1816 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDGAGEPPSMTQLLRR

SEQ ID NO: 1817 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDGASEPPSMTQLLRR

SEQ ID NO: 1818 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDGAAEPPSMTQLLRR

SEQ ID NO: 1819 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDSGGEPPSMTQLLRR

SEQ ID NO: 1820 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDSGSEPPSMTQLLRR

SEQ ID NO: 1821 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDSGAEPPSMTQLLRR

SEQ ID NO: 1822 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDSSGEPPSMTQLLRR

SEQ ID NO: 1823 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDSSSEPPSMTQLLRR

SEQ ID NO: 1824 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDSSAEPPSMTQLLRR

SEQ ID NO: 1825 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDSAGEPPSMTQLLRR

SEQ ID NO: 1826 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDSASEPPSMTQLLRR

SEQ ID NO: 1827 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDSAAEPPSMTQLLRR

SEQ ID NO: 1828 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDAGGEPPSMTQLLRR

SEQ ID NO: 1829 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDAGSEPPSMTQLLRR

SEQ ID NO: 1830 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDAGAEPPSMTQLLRR

SEQ ID NO: 1831 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDASGEPPSMTQLLRR

SEQ ID NO: 1832 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDASSEPPSMTQLLRR

SEQ ID NO: 1833 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDASAEPPSMTQLLRR

SEQ ID NO: 1834 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDAAGEPPSMTQLLRR

SEQ ID NO: 1835 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDAASEPPSMTQLLRR

SEQ ID NO: 1836 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKYGVSNKDIEKETAKDAAAEPPSMTQLLRR

SEQ ID NO: 1837 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDGGGEPPSMTQLLRR

SEQ ID NO: 1838 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDGGSEPPSMTQLLRR

SEQ ID NO: 1839 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDGGAEPPSMTQLLRR

SEQ ID NO: 1840 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDGSGEPPSMTQLLRR

SEQ ID NO: 1841 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDGSSEPPSMTQLLRR

SEQ ID NO: 1842 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDGSAEPPSMTQLLRR

SEQ ID NO: 1843 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDGAGEPPSMTQLLRR

SEQ ID NO: 1844 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDGASEPPSMTQLLRR

SEQ ID NO: 1845 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDGAAEPPSMTQLLRR

SEQ ID NO: 1846 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDSGGEPPSMTQLLRR

SEQ ID NO: 1847 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDSGSEPPSMTQLLRR

SEQ ID NO: 1848 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDSGAEPPSMTQLLRR

SEQ ID NO: 1849 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDSSGEPPSMTQLLRR

SEQ ID NO: 1850 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDSSSEPPSMTQLLRR

SEQ ID NO: 1851 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDSSAEPPSMTQLLRR

SEQ ID NO: 1852 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDSAGEPPSMTQLLRR

SEQ ID NO: 1853 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDSASEPPSMTQLLRR

SEQ ID NO: 1854 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDSAAEPPSMTQLLRR

SEQ ID NO: 1855 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDAGGEPPSMTQLLRR

SEQ ID NO: 1856 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDAGSEPPSMTQLLRR

SEQ ID NO: 1857 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDAGAEPPSMTQLLRR

SEQ ID NO: 1858 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDASGEPPSMTQLLRR

SEQ ID NO: 1859 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDASSEPPSMTQLLRR

SEQ ID NO: 1860 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDASAEPPSMTQLLRR

SEQ ID NO: 1861 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDAAGEPPSMTQLLRR

SEQ ID NO: 1862 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDAASEPPSMTQLLRR

SEQ ID NO: 1863 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKKGVSNKDIEKETAKDAAAEPPSMTQLLRR

SEQ ID NO: 1864 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDGGGEPPSMTQLLRR

SEQ ID NO: 1865 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDGGSEPPSMTQLLRR

SEQ ID NO: 1866 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDGGAEPPSMTQLLRR

SEQ ID NO: 1867 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDGSGEPPSMTQLLRR

SEQ ID NO: 1868 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDGSSEPPSMTQLLRR

SEQ ID NO: 1869 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDGSAEPPSMTQLLRR

SEQ ID NO: 1870 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDGAGEPPSMTQLLRR

SEQ ID NO: 1871 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDGASEPPSMTQLLRR

SEQ ID NO: 1872 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDGAAEPPSMTQLLRR

SEQ ID NO: 1873 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDSGGEPPSMTQLLRR

SEQ ID NO: 1874 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDSGSEPPSMTQLLRR

SEQ ID NO: 1875 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDSGAEPPSMTQLLRR

SEQ ID NO: 1876 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDSSGEPPSMTQLLRR

SEQ ID NO: 1877 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDSSSEPPSMTQLLRR

SEQ ID NO: 1878 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDSSAEPPSMTQLLRR

SEQ ID NO: 1879 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDSAGEPPSMTQLLRR

SEQ ID NO: 1880 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDSASEPPSMTQLLRR

SEQ ID NO: 1881 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDSAAEPPSMTQLLRR

SEQ ID NO: 1882 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDAGGEPPSMTQLLRR

SEQ ID NO: 1883 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDAGSEPPSMTQLLRR

SEQ ID NO: 1884 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDAGAEPPSMTQLLRR

SEQ ID NO: 1885 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDASGEPPSMTQLLRR

SEQ ID NO: 1886 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDASSEPPSMTQLLRR

SEQ ID NO: 1887 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDASAEPPSMTQLLRR

SEQ ID NO: 1888 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDAAGEPPSMTQLLRR

SEQ ID NO: 1889 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDAASEPPSMTQLLRR

SEQ ID NO: 1890 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKNGVSNKDIEKETAKDAAAEPPSMTQLLRR

SEQ ID NO: 1891 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDGGGEPPSMTQLLRR

SEQ ID NO: 1892 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDGGSEPPSMTQLLRR

SEQ ID NO: 1893 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDGGAEPPSMTQLLRR

SEQ ID NO: 1894 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDGSGEPPSMTQLLRR

SEQ ID NO: 1895 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDGSSEPPSMTQLLRR

SEQ ID NO: 1896 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDGSAEPPSMTQLLRR

SEQ ID NO: 1897 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDGAGEPPSMTQLLRR

SEQ ID NO: 1898 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDGASEPPSMTQLLRR

SEQ ID NO: 1899 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDGAAEPPSMTQLLRR

SEQ ID NO: 1900 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDSGGEPPSMTQLLRR

SEQ ID NO: 1901 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDSGSEPPSMTQLLRR

SEQ ID NO: 1902 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDSGAEPPSMTQLLRR

SEQ ID NO: 1903 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDSSGEPPSMTQLLRR

SEQ ID NO: 1904 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDSSSEPPSMTQLLRR

SEQ ID NO: 1905 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDSSAEPPSMTQLLRR

SEQ ID NO: 1906 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDSAGEPPSMTQLLRR

SEQ ID NO: 1907 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDSASEPPSMTQLLRR

SEQ ID NO: 1908 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDSAAEPPSMTQLLRR

SEQ ID NO: 1909 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDAGGEPPSMTQLLRR

SEQ ID NO: 1910 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDAGSEPPSMTQLLRR

SEQ ID NO: 1911 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDAGAEPPSMTQLLRR

SEQ ID NO: 1912 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDASGEPPSMTQLLRR

SEQ ID NO: 1913 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDASSEPPSMTQLLRR

SEQ ID NO: 1914 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDASAEPPSMTQLLRR

SEQ ID NO: 1915 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDAAGEPPSMTQLLRR

SEQ ID NO: 1916 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDAASEPPSMTQLLRR

SEQ ID NO: 1917 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDYFGLRGLLHLENASYGIEPLQNSSHFEHIIYRMDDVYKEPLKMGVSNKDIEKETAKDAAAEPPSMTQLLRR

SEQ ID NO: 1918 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDGGGEPPSMTQLLRR

SEQ ID NO: 1919 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDGGSEPPSMTQLLRR

SEQ ID NO: 1920 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDGGAEPPSMTQLLRR

SEQ ID NO: 1921 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDGSGEPPSMTQLLRR

SEQ ID NO: 1922 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDGSSEPPSMTQLLRR

SEQ ID NO: 1923 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDGSAEPPSMTQLLRR

SEQ ID NO: 1924 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDGAGEPPSMTQLLRR

SEQ ID NO: 1925 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDGASEPPSMTQLLRR

SEQ ID NO: 1926 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDGAAEPPSMTQLLRR

SEQ ID NO: 1927 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDSGGEPPSMTQLLRR

SEQ ID NO: 1928 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDSGSEPPSMTQLLRR

SEQ ID NO: 1929 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDSGAEPPSMTQLLRR

SEQ ID NO: 1930 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDSSGEPPSMTQLLRR

SEQ ID NO: 1931 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDSSSEPPSMTQLLRR

SEQ ID NO: 1932 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDSSAEPPSMTQLLRR

SEQ ID NO: 1933 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDSAGEPPSMTQLLRR

SEQ ID NO: 1934 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDSASEPPSMTQLLRR

SEQ ID NO: 1935 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDSAAEPPSMTQLLRR

SEQ ID NO: 1936 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDAGGEPPSMTQLLRR

SEQ ID NO: 1937 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDAGSEPPSMTQLLRR

SEQ ID NO: 1938 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDAGAEPPSMTQLLRR

SEQ ID NO: 1939 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDASGEPPSMTQLLRR

SEQ ID NO: 1940 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDASSEPPSMTQLLRR

SEQ ID NO: 1941 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDASAEPPSMTQLLRR

SEQ ID NO: 1942 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDAAGEPPSMTQLLRR

SEQ ID NO: 1943 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDAASEPPSMTQLLRR

SEQ ID NO: 1944 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKCGVSNKDIEKETAKDAAAEPPSMTQLLRR

SEQ ID NO: 1945 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDGGGEPPSMTQLLRR

SEQ ID NO: 1946 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDGGSEPPSMTQLLRR

SEQ ID NO: 1947 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDGGAEPPSMTQLLRR

SEQ ID NO: 1948 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDGSGEPPSMTQLLRR

SEQ ID NO: 1949 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDGSSEPPSMTQLLRR

SEQ ID NO: 1950 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDGSAEPPSMTQLLRR

SEQ ID NO: 1951 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDGAGEPPSMTQLLRR

SEQ ID NO: 1952 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDGASEPPSMTQLLRR

SEQ ID NO: 1953 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDGAAEPPSMTQLLRR

SEQ ID NO: 1954 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDSGGEPPSMTQLLRR

SEQ ID NO: 1955 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDSGSEPPSMTQLLRR

SEQ ID NO: 1956 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDSGAEPPSMTQLLRR

SEQ ID NO: 1957 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDSSGEPPSMTQLLRR

SEQ ID NO: 1958 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDSSSEPPSMTQLLRR

SEQ ID NO: 1959 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDSSAEPPSMTQLLRR

SEQ ID NO: 1960 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDSAGEPPSMTQLLRR

SEQ ID NO: 1961 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDSASEPPSMTQLLRR

SEQ ID NO: 1962 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDSAAEPPSMTQLLRR

SEQ ID NO: 1963 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDAGGEPPSMTQLLRR

SEQ ID NO: 1964 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDAGSEPPSMTQLLRR

SEQ ID NO: 1965 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDAGAEPPSMTQLLRR

SEQ ID NO: 1966 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDASGEPPSMTQLLRR

SEQ ID NO: 1967 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDASSEPPSMTQLLRR

SEQ ID NO: 1968 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDASAEPPSMTQLLRR

SEQ ID NO: 1969 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDAAGEPPSMTQLLRR

SEQ ID NO: 1970 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDAASEPPSMTQLLRR

SEQ ID NO: 1971 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKSGVSNKDIEKETAKDAAAEPPSMTQLLRR

SEQ ID NO: 1972 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDGGGEPPSMTQLLRR

SEQ ID NO: 1973 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDGGSEPPSMTQLLRR

SEQ ID NO: 1974 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDGGAEPPSMTQLLRR

SEQ ID NO: 1975 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDGSGEPPSMTQLLRR

SEQ ID NO: 1976 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDGSSEPPSMTQLLRR

SEQ ID NO: 1977 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDGSAEPPSMTQLLRR

SEQ ID NO: 1978 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDGAGEPPSMTQLLRR

SEQ ID NO: 1979 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDGASEPPSMTQLLRR

SEQ ID NO: 1980 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDGAAEPPSMTQLLRR

SEQ ID NO: 1981 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDSGGEPPSMTQLLRR

SEQ ID NO: 1982 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDSGSEPPSMTQLLRR

SEQ ID NO: 1983 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDSGAEPPSMTQLLRR

SEQ ID NO: 1984 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDSSGEPPSMTQLLRR

SEQ ID NO: 1985 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDSSSEPPSMTQLLRR

SEQ ID NO: 1986 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDSSAEPPSMTQLLRR

SEQ ID NO: 1987 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDSAGEPPSMTQLLRR

SEQ ID NO: 1988 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDSASEPPSMTQLLRR

SEQ ID NO: 1989 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDSAAEPPSMTQLLRR

SEQ ID NO: 1990 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDAGGEPPSMTQLLRR

SEQ ID NO: 1991 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDAGSEPPSMTQLLRR

SEQ ID NO: 1992 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDAGAEPPSMTQLLRR

SEQ ID NO: 1993 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDASGEPPSMTQLLRR

SEQ ID NO: 1994 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDASSEPPSMTQLLRR

SEQ ID NO: 1995 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDASAEPPSMTQLLRR

SEQ ID NO: 1996 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDAAGEPPSMTQLLRR

SEQ ID NO: 1997 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDAASEPPSMTQLLRR

SEQ ID NO: 1998 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKAGVSNKDIEKETAKDAAAEPPSMTQLLRR

SEQ ID NO: 1999 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDGGGEPPSMTQLLRR

SEQ ID NO: 2000 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDGGSEPPSMTQLLRR

SEQ ID NO: 2001 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDGGAEPPSMTQLLRR

SEQ ID NO: 2002 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDGSGEPPSMTQLLRR

SEQ ID NO: 2003 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDGSSEPPSMTQLLRR

SEQ ID NO: 2004 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDGSAEPPSMTQLLRR

SEQ ID NO: 2005 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDGAGEPPSMTQLLRR

SEQ ID NO: 2006 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDGASEPPSMTQLLRR

SEQ ID NO: 2007 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDGAAEPPSMTQLLRR

SEQ ID NO: 2008 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDSGGEPPSMTQLLRR

SEQ ID NO: 2009 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDSGSEPPSMTQLLRR

SEQ ID NO: 2010 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDSGAEPPSMTQLLRR

SEQ ID NO: 2011 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDSSGEPPSMTQLLRR

SEQ ID NO: 2012 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDSSSEPPSMTQLLRR

SEQ ID NO: 2013 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDSSAEPPSMTQLLRR

SEQ ID NO: 2014 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDSAGEPPSMTQLLRR

SEQ ID NO: 2015 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDSASEPPSMTQLLRR

SEQ ID NO: 2016 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDSAAEPPSMTQLLRR

SEQ ID NO: 2017 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDAGGEPPSMTQLLRR

SEQ ID NO: 2018 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDAGSEPPSMTQLLRR

SEQ ID NO: 2019 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDAGAEPPSMTQLLRR

SEQ ID NO: 2020 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDASGEPPSMTQLLRR

SEQ ID NO: 2021 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDASSEPPSMTQLLRR

SEQ ID NO: 2022 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDASAEPPSMTQLLRR

SEQ ID NO: 2023 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDAAGEPPSMTQLLRR

SEQ ID NO: 2024 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDAASEPPSMTQLLRR

SEQ ID NO: 2025 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKGGVSNKDIEKETAKDAAAEPPSMTQLLRR

SEQ ID NO: 2026 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDGGGEPPSMTQLLRR

SEQ ID NO: 2027 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDGGSEPPSMTQLLRR

SEQ ID NO: 2028 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDGGAEPPSMTQLLRR

SEQ ID NO: 2029 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDGSGEPPSMTQLLRR

SEQ ID NO: 2030 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDGSSEPPSMTQLLRR

SEQ ID NO: 2031 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDGSAEPPSMTQLLRR

SEQ ID NO: 2032 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDGAGEPPSMTQLLRR

SEQ ID NO: 2033 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDGASEPPSMTQLLRR

SEQ ID NO: 2034 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDGAAEPPSMTQLLRR

SEQ ID NO: 2035 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDSGGEPPSMTQLLRR

SEQ ID NO: 2036 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDSGSEPPSMTQLLRR

SEQ ID NO: 2037 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDSGAEPPSMTQLLRR

SEQ ID NO: 2038 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDSSGEPPSMTQLLRR

SEQ ID NO: 2039 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDSSSEPPSMTQLLRR

SEQ ID NO: 2040 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDSSAEPPSMTQLLRR

SEQ ID NO: 2041 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDSAGEPPSMTQLLRR

SEQ ID NO: 2042 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDSASEPPSMTQLLRR

SEQ ID NO: 2043 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDSAAEPPSMTQLLRR

SEQ ID NO: 2044 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDAGGEPPSMTQLLRR

SEQ ID NO: 2045 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDAGSEPPSMTQLLRR

SEQ ID NO: 2046 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDAGAEPPSMTQLLRR

SEQ ID NO: 2047 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDASGEPPSMTQLLRR

SEQ ID NO: 2048 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDASSEPPSMTQLLRR

SEQ ID NO: 2049 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDASAEPPSMTQLLRR

SEQ ID NO: 2050 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDAAGEPPSMTQLLRR

SEQ ID NO: 2051 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDAASEPPSMTQLLRR

SEQ ID NO: 2052 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKDGVSNKDIEKETAKDAAAEPPSMTQLLRR

SEQ ID NO: 2053 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDGGGEPPSMTQLLRR

SEQ ID NO: 2054 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDGGSEPPSMTQLLRR

SEQ ID NO: 2055 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDGGAEPPSMTQLLRR

SEQ ID NO: 2056 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDGSGEPPSMTQLLRR

SEQ ID NO: 2057 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDGSSEPPSMTQLLRR

SEQ ID NO: 2058 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDGSAEPPSMTQLLRR

SEQ ID NO: 2059 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDGAGEPPSMTQLLRR

SEQ ID NO: 2060 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDGASEPPSMTQLLRR

SEQ ID NO: 2061 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDGAAEPPSMTQLLRR

SEQ ID NO: 2062 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDSGGEPPSMTQLLRR

SEQ ID NO: 2063 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDSGSEPPSMTQLLRR

SEQ ID NO: 2064 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDSGAEPPSMTQLLRR

SEQ ID NO: 2065 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDSSGEPPSMTQLLRR

SEQ ID NO: 2066 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDSSSEPPSMTQLLRR

SEQ ID NO: 2067 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDSSAEPPSMTQLLRR

SEQ ID NO: 2068 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDSAGEPPSMTQLLRR

SEQ ID NO: 2069 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDSASEPPSMTQLLRR

SEQ ID NO: 2070 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDSAAEPPSMTQLLRR

SEQ ID NO: 2071 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDAGGEPPSMTQLLRR

SEQ ID NO: 2072 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDAGSEPPSMTQLLRR

SEQ ID NO: 2073 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDAGAEPPSMTQLLRR

SEQ ID NO: 2074 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDASGEPPSMTQLLRR

SEQ ID NO: 2075 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDASSEPPSMTQLLRR

SEQ ID NO: 2076 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDASAEPPSMTQLLRR

SEQ ID NO: 2077 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDAAGEPPSMTQLLRR

SEQ ID NO: 2078 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDAASEPPSMTQLLRR

SEQ ID NO: 2079 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKHGVSNKDIEKETAKDAAAEPPSMTQLLRR

SEQ ID NO: 2080 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDGGGEPPSMTQLLRR

SEQ ID NO: 2081 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDGGSEPPSMTQLLRR

SEQ ID NO: 2082 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDGGAEPPSMTQLLRR

SEQ ID NO: 2083 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDGSGEPPSMTQLLRR

SEQ ID NO: 2084 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDGSSEPPSMTQLLRR

SEQ ID NO: 2085 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDGSAEPPSMTQLLRR

SEQ ID NO: 2086 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDGAGEPPSMTQLLRR

SEQ ID NO: 2087 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDGASEPPSMTQLLRR

SEQ ID NO: 2088 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDGAAEPPSMTQLLRR

SEQ ID NO: 2089 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDSGGEPPSMTQLLRR

SEQ ID NO: 2090 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDSGSEPPSMTQLLRR

SEQ ID NO: 2091 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDSGAEPPSMTQLLRR

SEQ ID NO: 2092 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDSSGEPPSMTQLLRR

SEQ ID NO: 2093 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDSSSEPPSMTQLLRR

SEQ ID NO: 2094 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDSSAEPPSMTQLLRR

SEQ ID NO: 2095 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDSAGEPPSMTQLLRR

SEQ ID NO: 2096 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDSASEPPSMTQLLRR

SEQ ID NO: 2097 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDSAAEPPSMTQLLRR

SEQ ID NO: 2098 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDAGGEPPSMTQLLRR

SEQ ID NO: 2099 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDAGSEPPSMTQLLRR

SEQ ID NO: 2100 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDAGAEPPSMTQLLRR

SEQ ID NO: 2101 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDASGEPPSMTQLLRR

SEQ ID NO: 2102 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDASSEPPSMTQLLRR

SEQ ID NO: 2103 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDASAEPPSMTQLLRR

SEQ ID NO: 2104 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDAAGEPPSMTQLLRR

SEQ ID NO: 2105 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDAASEPPSMTQLLRR

SEQ ID NO: 2106 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKYGVSNKDIEKETAKDAAAEPPSMTQLLRR

SEQ ID NO: 2107 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDGGGEPPSMTQLLRR

SEQ ID NO: 2108 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDGGSEPPSMTQLLRR

SEQ ID NO: 2109 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDGGAEPPSMTQLLRR

SEQ ID NO: 2110 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDGSGEPPSMTQLLRR

SEQ ID NO: 2111 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDGSSEPPSMTQLLRR

SEQ ID NO: 2112 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDGSAEPPSMTQLLRR

SEQ ID NO: 2113 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDGAGEPPSMTQLLRR

SEQ ID NO: 2114 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDGASEPPSMTQLLRR

SEQ ID NO: 2115 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDGAAEPPSMTQLLRR

SEQ ID NO: 2116 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDSGGEPPSMTQLLRR

SEQ ID NO: 2117 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDSGSEPPSMTQLLRR

SEQ ID NO: 2118 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDSGAEPPSMTQLLRR

SEQ ID NO: 2119 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDSSGEPPSMTQLLRR

SEQ ID NO: 2120 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDSSSEPPSMTQLLRR

SEQ ID NO: 2121 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDSSAEPPSMTQLLRR

SEQ ID NO: 2122 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDSAGEPPSMTQLLRR

SEQ ID NO: 2123 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDSASEPPSMTQLLRR

SEQ ID NO: 2124 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDSAAEPPSMTQLLRR

SEQ ID NO: 2125 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDAGGEPPSMTQLLRR

SEQ ID NO: 2126 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDAGSEPPSMTQLLRR

SEQ ID NO: 2127 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDAGAEPPSMTQLLRR

SEQ ID NO: 2128 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDASGEPPSMTQLLRR

SEQ ID NO: 2129 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDASSEPPSMTQLLRR

SEQ ID NO: 2130 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDASAEPPSMTQLLRR

SEQ ID NO: 2131 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDAAGEPPSMTQLLRR

SEQ ID NO: 2132 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDAASEPPSMTQLLRR

SEQ ID NO: 2133 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKKGVSNKDIEKETAKDAAAEPPSMTQLLRR

SEQ ID NO: 2134 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDGGGEPPSMTQLLRR

SEQ ID NO: 2135 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDGGSEPPSMTQLLRR

SEQ ID NO: 2136 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDGGAEPPSMTQLLRR

SEQ ID NO: 2137 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDGSGEPPSMTQLLRR

SEQ ID NO: 2138 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDGSSEPPSMTQLLRR

SEQ ID NO: 2139 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDGSAEPPSMTQLLRR

SEQ ID NO: 2140 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDGAGEPPSMTQLLRR

SEQ ID NO: 2141 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDGASEPPSMTQLLRR

SEQ ID NO: 2142 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDGAAEPPSMTQLLRR

SEQ ID NO: 2143 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDSGGEPPSMTQLLRR

SEQ ID NO: 2144 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDSGSEPPSMTQLLRR

SEQ ID NO: 2145 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDSGAEPPSMTQLLRR

SEQ ID NO: 2146 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDSSGEPPSMTQLLRR

SEQ ID NO: 2147 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDSSSEPPSMTQLLRR

SEQ ID NO: 2148 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDSSAEPPSMTQLLRR

SEQ ID NO: 2149 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDSAGEPPSMTQLLRR

SEQ ID NO: 2150 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDSASEPPSMTQLLRR

SEQ ID NO: 2151 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDSAAEPPSMTQLLRR

SEQ ID NO: 2152 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDAGGEPPSMTQLLRR

SEQ ID NO: 2153 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDAGSEPPSMTQLLRR

SEQ ID NO: 2154 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDAGAEPPSMTQLLRR

SEQ ID NO: 2155 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDASGEPPSMTQLLRR

SEQ ID NO: 2156 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDASSEPPSMTQLLRR

SEQ ID NO: 2157 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDASAEPPSMTQLLRR

SEQ ID NO: 2158 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDAAGEPPSMTQLLRR

SEQ ID NO: 2159 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDAASEPPSMTQLLRR

SEQ ID NO: 2160 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKNGVSNKDIEKETAKDAAAEPPSMTQLLRR

SEQ ID NO: 2161 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDGGGEPPSMTQLLRR

SEQ ID NO: 2162 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDGGSEPPSMTQLLRR

SEQ ID NO: 2163 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDGGAEPPSMTQLLRR

SEQ ID NO: 2164 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDGSGEPPSMTQLLRR

SEQ ID NO: 2165 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDGSSEPPSMTQLLRR

SEQ ID NO: 2166 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDGSAEPPSMTQLLRR

SEQ ID NO: 2167 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDGAGEPPSMTQLLRR

SEQ ID NO: 2168 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDGASEPPSMTQLLRR

SEQ ID NO: 2169 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDGAAEPPSMTQLLRR

SEQ ID NO: 2170 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDSGGEPPSMTQLLRR

SEQ ID NO: 2171 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDSGSEPPSMTQLLRR

SEQ ID NO: 2172 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDSGAEPPSMTQLLRR

SEQ ID NO: 2173 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDSSGEPPSMTQLLRR

SEQ ID NO: 2174 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDSSSEPPSMTQLLRR

SEQ ID NO: 2175 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDSSAEPPSMTQLLRR

SEQ ID NO: 2176 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDSAGEPPSMTQLLRR

SEQ ID NO: 2177 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDSASEPPSMTQLLRR

SEQ ID NO: 2178 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDSAAEPPSMTQLLRR

SEQ ID NO: 2179 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDAGGEPPSMTQLLRR

SEQ ID NO: 2180 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDAGSEPPSMTQLLRR

SEQ ID NO: 2181 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDAGAEPPSMTQLLRR

SEQ ID NO: 2182 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDASGEPPSMTQLLRR

SEQ ID NO: 2183 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDASSEPPSMTQLLRR

SEQ ID NO: 2184 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDASAEPPSMTQLLRR

SEQ ID NO: 2185 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDAAGEPPSMTQLLRR

SEQ ID NO: 2186 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDAASEPPSMTQLLRR

SEQ ID NO: 2187 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDKFGLRGLLHLENASYGIEPLQNSSHFEHIIYRMDDVYKEPLKMGVSNKDIEKETAKDAAAEPPSMTQLLRR

SEQ ID NO: 2188 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDGGGEPPSMTQLLRR

SEQ ID NO: 2189 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDGGSEPPSMTQLLRR

SEQ ID NO: 2190 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDGGAEPPSMTQLLRR

SEQ ID NO: 2191 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDGSGEPPSMTQLLRR

SEQ ID NO: 2192 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDGSSEPPSMTQLLRR

SEQ ID NO: 2193 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDGSAEPPSMTQLLRR

SEQ ID NO: 2194 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDGAGEPPSMTQLLRR

SEQ ID NO: 2195 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDGASEPPSMTQLLRR

SEQ ID NO: 2196 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDGAAEPPSMTQLLRR

SEQ ID NO: 2197 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDSGGEPPSMTQLLRR

SEQ ID NO: 2198 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDSGSEPPSMTQLLRR

SEQ ID NO: 2199 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDSGAEPPSMTQLLRR

SEQ ID NO: 2200 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDSSGEPPSMTQLLRR

SEQ ID NO: 2201 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDSSSEPPSMTQLLRR

SEQ ID NO: 2202 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDSSAEPPSMTQLLRR

SEQ ID NO: 2203 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDSAGEPPSMTQLLRR

SEQ ID NO: 2204 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDSASEPPSMTQLLRR

SEQ ID NO: 2205 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDSAAEPPSMTQLLRR

SEQ ID NO: 2206 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDAGGEPPSMTQLLRR

SEQ ID NO: 2207 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDAGSEPPSMTQLLRR

SEQ ID NO: 2208 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDAGAEPPSMTQLLRR

SEQ ID NO: 2209 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDASGEPPSMTQLLRR

SEQ ID NO: 2210 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDASSEPPSMTQLLRR

SEQ ID NO: 2211 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDASAEPPSMTQLLRR

SEQ ID NO: 2212 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDAAGEPPSMTQLLRR

SEQ ID NO: 2213 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDAASEPPSMTQLLRR

SEQ ID NO: 2214 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKCGVSNKDIEKETAKDAAAEPPSMTQLLRR

SEQ ID NO: 2215 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDGGGEPPSMTQLLRR

SEQ ID NO: 2216 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDGGSEPPSMTQLLRR

SEQ ID NO: 2217 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDGGAEPPSMTQLLRR

SEQ ID NO: 2218 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDGSGEPPSMTQLLRR

SEQ ID NO: 2219 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDGSSEPPSMTQLLRR

SEQ ID NO: 2220 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDGSAEPPSMTQLLRR

SEQ ID NO: 2221 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDGAGEPPSMTQLLRR

SEQ ID NO: 2222 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDGASEPPSMTQLLRR

SEQ ID NO: 2223 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDGAAEPPSMTQLLRR

SEQ ID NO: 2224 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDSGGEPPSMTQLLRR

SEQ ID NO: 2225 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDSGSEPPSMTQLLRR

SEQ ID NO: 2226 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDSGAEPPSMTQLLRR

SEQ ID NO: 2227 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDSSGEPPSMTQLLRR

SEQ ID NO: 2228 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDSSSEPPSMTQLLRR

SEQ ID NO: 2229 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDSSAEPPSMTQLLRR

SEQ ID NO: 2230 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDSAGEPPSMTQLLRR

SEQ ID NO: 2231 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDSASEPPSMTQLLRR

SEQ ID NO: 2232 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDSAAEPPSMTQLLRR

SEQ ID NO: 2233 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDAGGEPPSMTQLLRR

SEQ ID NO: 2234 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDAGSEPPSMTQLLRR

SEQ ID NO: 2235 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDAGAEPPSMTQLLRR

SEQ ID NO: 2236 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDASGEPPSMTQLLRR

SEQ ID NO: 2237 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDASSEPPSMTQLLRR

SEQ ID NO: 2238 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDASAEPPSMTQLLRR

SEQ ID NO: 2239 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDAAGEPPSMTQLLRR

SEQ ID NO: 2240 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDAASEPPSMTQLLRR

SEQ ID NO: 2241 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKSGVSNKDIEKETAKDAAAEPPSMTQLLRR

SEQ ID NO: 2242 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDGGGEPPSMTQLLRR

SEQ ID NO: 2243 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDGGSEPPSMTQLLRR

SEQ ID NO: 2244 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDGGAEPPSMTQLLRR

SEQ ID NO: 2245 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDGSGEPPSMTQLLRR

SEQ ID NO: 2246 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDGSSEPPSMTQLLRR

SEQ ID NO: 2247 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDGSAEPPSMTQLLRR

SEQ ID NO: 2248 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDGAGEPPSMTQLLRR

SEQ ID NO: 2249 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDGASEPPSMTQLLRR

SEQ ID NO: 2250 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDGAAEPPSMTQLLRR

SEQ ID NO: 2251 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDSGGEPPSMTQLLRR

SEQ ID NO: 2252 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDSGSEPPSMTQLLRR

SEQ ID NO: 2253 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDSGAEPPSMTQLLRR

SEQ ID NO: 2254 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDSSGEPPSMTQLLRR

SEQ ID NO: 2255 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDSSSEPPSMTQLLRR

SEQ ID NO: 2256 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDSSAEPPSMTQLLRR

SEQ ID NO: 2257 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDSAGEPPSMTQLLRR

SEQ ID NO: 2258 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDSASEPPSMTQLLRR

SEQ ID NO: 2259 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDSAAEPPSMTQLLRR

SEQ ID NO: 2260 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDAGGEPPSMTQLLRR

SEQ ID NO: 2261 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDAGSEPPSMTQLLRR

SEQ ID NO: 2262 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDAGAEPPSMTQLLRR

SEQ ID NO: 2263 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDASGEPPSMTQLLRR

SEQ ID NO: 2264 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDASSEPPSMTQLLRR

SEQ ID NO: 2265 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDASAEPPSMTQLLRR

SEQ ID NO: 2266 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDAAGEPPSMTQLLRR

SEQ ID NO: 2267 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDAASEPPSMTQLLRR

SEQ ID NO: 2268 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKAGVSNKDIEKETAKDAAAEPPSMTQLLRR

SEQ ID NO: 2269 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDGGGEPPSMTQLLRR

SEQ ID NO: 2270 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDGGSEPPSMTQLLRR

SEQ ID NO: 2271 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDGGAEPPSMTQLLRR

SEQ ID NO: 2272 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDGSGEPPSMTQLLRR

SEQ ID NO: 2273 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDGSSEPPSMTQLLRR

SEQ ID NO: 2274 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDGSAEPPSMTQLLRR

SEQ ID NO: 2275 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDGAGEPPSMTQLLRR

SEQ ID NO: 2276 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDGASEPPSMTQLLRR

SEQ ID NO: 2277 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDGAAEPPSMTQLLRR

SEQ ID NO: 2278 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDSGGEPPSMTQLLRR

SEQ ID NO: 2279 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDSGSEPPSMTQLLRR

SEQ ID NO: 2280 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDSGAEPPSMTQLLRR

SEQ ID NO: 2281 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDSSGEPPSMTQLLRR

SEQ ID NO: 2282 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDSSSEPPSMTQLLRR

SEQ ID NO: 2283 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDSSAEPPSMTQLLRR

SEQ ID NO: 2284 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDSAGEPPSMTQLLRR

SEQ ID NO: 2285 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDSASEPPSMTQLLRR

SEQ ID NO: 2286 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDSAAEPPSMTQLLRR

SEQ ID NO: 2287 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDAGGEPPSMTQLLRR

SEQ ID NO: 2288 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDAGSEPPSMTQLLRR

SEQ ID NO: 2289 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDAGAEPPSMTQLLRR

SEQ ID NO: 2290 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDASGEPPSMTQLLRR

SEQ ID NO: 2291 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDASSEPPSMTQLLRR

SEQ ID NO: 2292 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDASAEPPSMTQLLRR

SEQ ID NO: 2293 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDAAGEPPSMTQLLRR

SEQ ID NO: 2294 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDAASEPPSMTQLLRR

SEQ ID NO: 2295 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKGGVSNKDIEKETAKDAAAEPPSMTQLLRR

SEQ ID NO: 2296 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDGGGEPPSMTQLLRR

SEQ ID NO: 2297 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDGGSEPPSMTQLLRR

SEQ ID NO: 2298 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDGGAEPPSMTQLLRR

SEQ ID NO: 2299 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDGSGEPPSMTQLLRR

SEQ ID NO: 2300 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDGSSEPPSMTQLLRR

SEQ ID NO: 2301 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDGSAEPPSMTQLLRR

SEQ ID NO: 2302 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDGAGEPPSMTQLLRR

SEQ ID NO: 2303 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDGASEPPSMTQLLRR

SEQ ID NO: 2304 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDGAAEPPSMTQLLRR

SEQ ID NO: 2305 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDSGGEPPSMTQLLRR

SEQ ID NO: 2306 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDSGSEPPSMTQLLRR

SEQ ID NO: 2307 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDSGAEPPSMTQLLRR

SEQ ID NO: 2308 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDSSGEPPSMTQLLRR

SEQ ID NO: 2309 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDSSSEPPSMTQLLRR

SEQ ID NO: 2310 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDSSAEPPSMTQLLRR

SEQ ID NO: 2311 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDSAGEPPSMTQLLRR

SEQ ID NO: 2312 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDSASEPPSMTQLLRR

SEQ ID NO: 2313 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDSAAEPPSMTQLLRR

SEQ ID NO: 2314 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDAGGEPPSMTQLLRR

SEQ ID NO: 2315 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDAGSEPPSMTQLLRR

SEQ ID NO: 2316 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDAGAEPPSMTQLLRR

SEQ ID NO: 2317 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDASGEPPSMTQLLRR

SEQ ID NO: 2318 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDASSEPPSMTQLLRR

SEQ ID NO: 2319 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDASAEPPSMTQLLRR

SEQ ID NO: 2320 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDAAGEPPSMTQLLRR

SEQ ID NO: 2321 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDAASEPPSMTQLLRR

SEQ ID NO: 2322 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKDGVSNKDIEKETAKDAAAEPPSMTQLLRR

SEQ ID NO: 2323 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDGGGEPPSMTQLLRR

SEQ ID NO: 2324 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDGGSEPPSMTQLLRR

SEQ ID NO: 2325 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDGGAEPPSMTQLLRR

SEQ ID NO: 2326 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDGSGEPPSMTQLLRR

SEQ ID NO: 2327 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDGSSEPPSMTQLLRR

SEQ ID NO: 2328 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDGSAEPPSMTQLLRR

SEQ ID NO: 2329 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDGAGEPPSMTQLLRR

SEQ ID NO: 2330 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDGASEPPSMTQLLRR

SEQ ID NO: 2331 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDGAAEPPSMTQLLRR

SEQ ID NO: 2332 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDSGGEPPSMTQLLRR

SEQ ID NO: 2333 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDSGSEPPSMTQLLRR

SEQ ID NO: 2334 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDSGAEPPSMTQLLRR

SEQ ID NO: 2335 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDSSGEPPSMTQLLRR

SEQ ID NO: 2336 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDSSSEPPSMTQLLRR

SEQ ID NO: 2337 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDSSAEPPSMTQLLRR

SEQ ID NO: 2338 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDSAGEPPSMTQLLRR

SEQ ID NO: 2339 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDSASEPPSMTQLLRR

SEQ ID NO: 2340 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDSAAEPPSMTQLLRR

SEQ ID NO: 2341 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDAGGEPPSMTQLLRR

SEQ ID NO: 2342 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDAGSEPPSMTQLLRR

SEQ ID NO: 2343 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDAGAEPPSMTQLLRR

SEQ ID NO: 2344 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDASGEPPSMTQLLRR

SEQ ID NO: 2345 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDASSEPPSMTQLLRR

SEQ ID NO: 2346 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDASAEPPSMTQLLRR

SEQ ID NO: 2347 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDAAGEPPSMTQLLRR

SEQ ID NO: 2348 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDAASEPPSMTQLLRR

SEQ ID NO: 2349 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKHGVSNKDIEKETAKDAAAEPPSMTQLLRR

SEQ ID NO: 2350 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDGGGEPPSMTQLLRR

SEQ ID NO: 2351 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDGGSEPPSMTQLLRR

SEQ ID NO: 2352 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDGGAEPPSMTQLLRR

SEQ ID NO: 2353 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDGSGEPPSMTQLLRR

SEQ ID NO: 2354 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDGSSEPPSMTQLLRR

SEQ ID NO: 2355 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDGSAEPPSMTQLLRR

SEQ ID NO: 2356 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDGAGEPPSMTQLLRR

SEQ ID NO: 2357 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDGASEPPSMTQLLRR

SEQ ID NO: 2358 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDGAAEPPSMTQLLRR

SEQ ID NO: 2359 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDSGGEPPSMTQLLRR

SEQ ID NO: 2360 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDSGSEPPSMTQLLRR

SEQ ID NO: 2361 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDSGAEPPSMTQLLRR

SEQ ID NO: 2362 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDSSGEPPSMTQLLRR

SEQ ID NO: 2363 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDSSSEPPSMTQLLRR

SEQ ID NO: 2364 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDSSAEPPSMTQLLRR

SEQ ID NO: 2365 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDSAGEPPSMTQLLRR

SEQ ID NO: 2366 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDSASEPPSMTQLLRR

SEQ ID NO: 2367 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDSAAEPPSMTQLLRR

SEQ ID NO: 2368 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDAGGEPPSMTQLLRR

SEQ ID NO: 2369 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDAGSEPPSMTQLLRR

SEQ ID NO: 2370 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDAGAEPPSMTQLLRR

SEQ ID NO: 2371 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDASGEPPSMTQLLRR

SEQ ID NO: 2372 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDASSEPPSMTQLLRR

SEQ ID NO: 2373 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDASAEPPSMTQLLRR

SEQ ID NO: 2374 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDAAGEPPSMTQLLRR

SEQ ID NO: 2375 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDAASEPPSMTQLLRR

SEQ ID NO: 2376 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKYGVSNKDIEKETAKDAAAEPPSMTQLLRR

SEQ ID NO: 2377 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDGGGEPPSMTQLLRR

SEQ ID NO: 2378 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDGGSEPPSMTQLLRR

SEQ ID NO: 2379 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDGGAEPPSMTQLLRR

SEQ ID NO: 2380 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDGSGEPPSMTQLLRR

SEQ ID NO: 2381 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDGSSEPPSMTQLLRR

SEQ ID NO: 2382 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDGSAEPPSMTQLLRR

SEQ ID NO: 2383 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDGAGEPPSMTQLLRR

SEQ ID NO: 2384 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDGASEPPSMTQLLRR

SEQ ID NO: 2385 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDGAAEPPSMTQLLRR

SEQ ID NO: 2386 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDSGGEPPSMTQLLRR

SEQ ID NO: 2387 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDSGSEPPSMTQLLRR

SEQ ID NO: 2388 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDSGAEPPSMTQLLRR

SEQ ID NO: 2389 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDSSGEPPSMTQLLRR

SEQ ID NO: 2390 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDSSSEPPSMTQLLRR

SEQ ID NO: 2391 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDSSAEPPSMTQLLRR

SEQ ID NO: 2392 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDSAGEPPSMTQLLRR

SEQ ID NO: 2393 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDSASEPPSMTQLLRR

SEQ ID NO: 2394 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDSAAEPPSMTQLLRR

SEQ ID NO: 2395 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDAGGEPPSMTQLLRR

SEQ ID NO: 2396 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDAGSEPPSMTQLLRR

SEQ ID NO: 2397 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDAGAEPPSMTQLLRR

SEQ ID NO: 2398 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDASGEPPSMTQLLRR

SEQ ID NO: 2399 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDASSEPPSMTQLLRR

SEQ ID NO: 2400 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDASAEPPSMTQLLRR

SEQ ID NO: 2401 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDAAGEPPSMTQLLRR

SEQ ID NO: 2402 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDAASEPPSMTQLLRR

SEQ ID NO: 2403 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKKGVSNKDIEKETAKDAAAEPPSMTQLLRR

SEQ ID NO: 2404 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDGGGEPPSMTQLLRR

SEQ ID NO: 2405 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDGGSEPPSMTQLLRR

SEQ ID NO: 2406 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDGGAEPPSMTQLLRR

SEQ ID NO: 2407 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDGSGEPPSMTQLLRR

SEQ ID NO: 2408 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDGSSEPPSMTQLLRR

SEQ ID NO: 2409 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDGSAEPPSMTQLLRR

SEQ ID NO: 2410 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDGAGEPPSMTQLLRR

SEQ ID NO: 2411 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDGASEPPSMTQLLRR

SEQ ID NO: 2412 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDGAAEPPSMTQLLRR

SEQ ID NO: 2413 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDSGGEPPSMTQLLRR

SEQ ID NO: 2414 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDSGSEPPSMTQLLRR

SEQ ID NO: 2415 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDSGAEPPSMTQLLRR

SEQ ID NO: 2416 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDSSGEPPSMTQLLRR

SEQ ID NO: 2417 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDSSSEPPSMTQLLRR

SEQ ID NO: 2418 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDSSAEPPSMTQLLRR

SEQ ID NO: 2419 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDSAGEPPSMTQLLRR

SEQ ID NO: 2420 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDSASEPPSMTQLLRR

SEQ ID NO: 2421 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDSAAEPPSMTQLLRR

SEQ ID NO: 2422 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDAGGEPPSMTQLLRR

SEQ ID NO: 2423 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDAGSEPPSMTQLLRR

SEQ ID NO: 2424 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDAGAEPPSMTQLLRR

SEQ ID NO: 2425 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDASGEPPSMTQLLRR

SEQ ID NO: 2426 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDASSEPPSMTQLLRR

SEQ ID NO: 2427 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDASAEPPSMTQLLRR

SEQ ID NO: 2428 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDAAGEPPSMTQLLRR

SEQ ID NO: 2429 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDAASEPPSMTQLLRR

SEQ ID NO: 2430 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKNGVSNKDIEKETAKDAAAEPPSMTQLLRR

SEQ ID NO: 2431 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDGGGEPPSMTQLLRR

SEQ ID NO: 2432 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDGGSEPPSMTQLLRR

SEQ ID NO: 2433 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDGGAEPPSMTQLLRR

SEQ ID NO: 2434 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDGSGEPPSMTQLLRR

SEQ ID NO: 2435 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDGSSEPPSMTQLLRR

SEQ ID NO: 2436 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDGSAEPPSMTQLLRR

SEQ ID NO: 2437 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDGAGEPPSMTQLLRR

SEQ ID NO: 2438 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDGASEPPSMTQLLRR

SEQ ID NO: 2439 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDGAAEPPSMTQLLRR

SEQ ID NO: 2440 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDSGGEPPSMTQLLRR

SEQ ID NO: 2441 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDSGSEPPSMTQLLRR

SEQ ID NO: 2442 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDSGAEPPSMTQLLRR

SEQ ID NO: 2443 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDSSGEPPSMTQLLRR

SEQ ID NO: 2444 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDSSSEPPSMTQLLRR

SEQ ID NO: 2445 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDSSAEPPSMTQLLRR

SEQ ID NO: 2446 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDSAGEPPSMTQLLRR

SEQ ID NO: 2447 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDSASEPPSMTQLLRR

SEQ ID NO: 2448 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDSAAEPPSMTQLLRR

SEQ ID NO: 2449 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDAGGEPPSMTQLLRR

SEQ ID NO: 2450 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDAGSEPPSMTQLLRR

SEQ ID NO: 2451 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDAGAEPPSMTQLLRR

SEQ ID NO: 2452 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDASGEPPSMTQLLRR

SEQ ID NO: 2453 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDASSEPPSMTQLLRR

SEQ ID NO: 2454 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDASAEPPSMTQLLRR

SEQ ID NO: 2455 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDAAGEPPSMTQLLRR

SEQ ID NO: 2456 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDAASEPPSMTQLLRR

SEQ ID NO: 2457 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDNFGLRGLLHLENASYGIEPLQNSSHFEHIIYRMDDVYKEPLKMGVSNKDIEKETAKDAAAEPPSMTQLLRR

SEQ ID NO: 2458 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDGGGEPPSMTQLLRR

SEQ ID NO: 2459 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDGGSEPPSMTQLLRR

SEQ ID NO: 2460 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDGGAEPPSMTQLLRR

SEQ ID NO: 2461 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDGSGEPPSMTQLLRR

SEQ ID NO: 2462 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDGSSEPPSMTQLLRR

SEQ ID NO: 2463 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDGSAEPPSMTQLLRR

SEQ ID NO: 2464 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDGAGEPPSMTQLLRR

SEQ ID NO: 2465 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDGASEPPSMTQLLRR

SEQ ID NO: 2466 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDGAAEPPSMTQLLRR

SEQ ID NO: 2467 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDSGGEPPSMTQLLRR

SEQ ID NO: 2468 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDSGSEPPSMTQLLRR

SEQ ID NO: 2469 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDSGAEPPSMTQLLRR

SEQ ID NO: 2470 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDSSGEPPSMTQLLRR

SEQ ID NO: 2471 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDSSSEPPSMTQLLRR

SEQ ID NO: 2472 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDSSAEPPSMTQLLRR

SEQ ID NO: 2473 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDSAGEPPSMTQLLRR

SEQ ID NO: 2474 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDSASEPPSMTQLLRR

SEQ ID NO: 2475 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDSAAEPPSMTQLLRR

SEQ ID NO: 2476 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDAGGEPPSMTQLLRR

SEQ ID NO: 2477 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDAGSEPPSMTQLLRR

SEQ ID NO: 2478 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDAGAEPPSMTQLLRR

SEQ ID NO: 2479 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDASGEPPSMTQLLRR

SEQ ID NO: 2480 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDASSEPPSMTQLLRR

SEQ ID NO: 2481 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDASAEPPSMTQLLRR

SEQ ID NO: 2482 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDAAGEPPSMTQLLRR

SEQ ID NO: 2483 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDAASEPPSMTQLLRR

SEQ ID NO: 2484 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKCGVSNKDIEKETAKDAAAEPPSMTQLLRR

SEQ ID NO: 2485 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDGGGEPPSMTQLLRR

SEQ ID NO: 2486 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDGGSEPPSMTQLLRR

SEQ ID NO: 2487 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDGGAEPPSMTQLLRR

SEQ ID NO: 2488 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDGSGEPPSMTQLLRR

SEQ ID NO: 2489 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDGSSEPPSMTQLLRR

SEQ ID NO: 2490 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDGSAEPPSMTQLLRR

SEQ ID NO: 2491 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDGAGEPPSMTQLLRR

SEQ ID NO: 2492 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDGASEPPSMTQLLRR

SEQ ID NO: 2493 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDGAAEPPSMTQLLRR

SEQ ID NO: 2494 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDSGGEPPSMTQLLRR

SEQ ID NO: 2495 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDSGSEPPSMTQLLRR

SEQ ID NO: 2496 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDSGAEPPSMTQLLRR

SEQ ID NO: 2497 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDSSGEPPSMTQLLRR

SEQ ID NO: 2498 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDSSSEPPSMTQLLRR

SEQ ID NO: 2499 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDSSAEPPSMTQLLRR

SEQ ID NO: 2500 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDSAGEPPSMTQLLRR

SEQ ID NO: 2501 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDSASEPPSMTQLLRR

SEQ ID NO: 2502 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDSAAEPPSMTQLLRR

SEQ ID NO: 2503 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDAGGEPPSMTQLLRR

SEQ ID NO: 2504 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDAGSEPPSMTQLLRR

SEQ ID NO: 2505 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDAGAEPPSMTQLLRR

SEQ ID NO: 2506 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDASGEPPSMTQLLRR

SEQ ID NO: 2507 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDASSEPPSMTQLLRR

SEQ ID NO: 2508 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDASAEPPSMTQLLRR

SEQ ID NO: 2509 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDAAGEPPSMTQLLRR

SEQ ID NO: 2510 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDAASEPPSMTQLLRR

SEQ ID NO: 2511 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKSGVSNKDIEKETAKDAAAEPPSMTQLLRR

SEQ ID NO: 2512 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDGGGEPPSMTQLLRR

SEQ ID NO: 2513 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDGGSEPPSMTQLLRR

SEQ ID NO: 2514 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDGGAEPPSMTQLLRR

SEQ ID NO: 2515 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDGSGEPPSMTQLLRR

SEQ ID NO: 2516 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDGSSEPPSMTQLLRR

SEQ ID NO: 2517 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDGSAEPPSMTQLLRR

SEQ ID NO: 2518 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDGAGEPPSMTQLLRR

SEQ ID NO: 2519 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDGASEPPSMTQLLRR

SEQ ID NO: 2520 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDGAAEPPSMTQLLRR

SEQ ID NO: 2521 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDSGGEPPSMTQLLRR

SEQ ID NO: 2522 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDSGSEPPSMTQLLRR

SEQ ID NO: 2523 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDSGAEPPSMTQLLRR

SEQ ID NO: 2524 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDSSGEPPSMTQLLRR

SEQ ID NO: 2525 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDSSSEPPSMTQLLRR

SEQ ID NO: 2526 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDSSAEPPSMTQLLRR

SEQ ID NO: 2527 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDSAGEPPSMTQLLRR

SEQ ID NO: 2528 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDSASEPPSMTQLLRR

SEQ ID NO: 2529 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDSAAEPPSMTQLLRR

SEQ ID NO: 2530 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDAGGEPPSMTQLLRR

SEQ ID NO: 2531 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDAGSEPPSMTQLLRR

SEQ ID NO: 2532 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDAGAEPPSMTQLLRR

SEQ ID NO: 2533 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDASGEPPSMTQLLRR

SEQ ID NO: 2534 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDASSEPPSMTQLLRR

SEQ ID NO: 2535 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDASAEPPSMTQLLRR

SEQ ID NO: 2536 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDAAGEPPSMTQLLRR

SEQ ID NO: 2537 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDAASEPPSMTQLLRR

SEQ ID NO: 2538 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKAGVSNKDIEKETAKDAAAEPPSMTQLLRR

SEQ ID NO: 2539 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDGGGEPPSMTQLLRR

SEQ ID NO: 2540 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDGGSEPPSMTQLLRR

SEQ ID NO: 2541 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDGGAEPPSMTQLLRR

SEQ ID NO: 2542 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDGSGEPPSMTQLLRR

SEQ ID NO: 2543 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDGSSEPPSMTQLLRR

SEQ ID NO: 2544 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDGSAEPPSMTQLLRR

SEQ ID NO: 2545 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDGAGEPPSMTQLLRR

SEQ ID NO: 2546 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDGASEPPSMTQLLRR

SEQ ID NO: 2547 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDGAAEPPSMTQLLRR

SEQ ID NO: 2548 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDSGGEPPSMTQLLRR

SEQ ID NO: 2549 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDSGSEPPSMTQLLRR

SEQ ID NO: 2550 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDSGAEPPSMTQLLRR

SEQ ID NO: 2551 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDSSGEPPSMTQLLRR

SEQ ID NO: 2552 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDSSSEPPSMTQLLRR

SEQ ID NO: 2553 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDSSAEPPSMTQLLRR

SEQ ID NO: 2554 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDSAGEPPSMTQLLRR

SEQ ID NO: 2555 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDSASEPPSMTQLLRR

SEQ ID NO: 2556 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDSAAEPPSMTQLLRR

SEQ ID NO: 2557 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDAGGEPPSMTQLLRR

SEQ ID NO: 2558 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDAGSEPPSMTQLLRR

SEQ ID NO: 2559 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDAGAEPPSMTQLLRR

SEQ ID NO: 2560 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDASGEPPSMTQLLRR

SEQ ID NO: 2561 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDASSEPPSMTQLLRR

SEQ ID NO: 2562 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDASAEPPSMTQLLRR

SEQ ID NO: 2563 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDAAGEPPSMTQLLRR

SEQ ID NO: 2564 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDAASEPPSMTQLLRR

SEQ ID NO: 2565 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKGGVSNKDIEKETAKDAAAEPPSMTQLLRR

SEQ ID NO: 2566 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDGGGEPPSMTQLLRR

SEQ ID NO: 2567 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDGGSEPPSMTQLLRR

SEQ ID NO: 2568 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDGGAEPPSMTQLLRR

SEQ ID NO: 2569 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDGSGEPPSMTQLLRR

SEQ ID NO: 2570 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDGSSEPPSMTQLLRR

SEQ ID NO: 2571 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDGSAEPPSMTQLLRR

SEQ ID NO: 2572 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDGAGEPPSMTQLLRR

SEQ ID NO: 2573 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDGASEPPSMTQLLRR

SEQ ID NO: 2574 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDGAAEPPSMTQLLRR

SEQ ID NO: 2575 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDSGGEPPSMTQLLRR

SEQ ID NO: 2576 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDSGSEPPSMTQLLRR

SEQ ID NO: 2577 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDSGAEPPSMTQLLRR

SEQ ID NO: 2578 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDSSGEPPSMTQLLRR

SEQ ID NO: 2579 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDSSSEPPSMTQLLRR

SEQ ID NO: 2580 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDSSAEPPSMTQLLRR

SEQ ID NO: 2581 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDSAGEPPSMTQLLRR

SEQ ID NO: 2582 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDSASEPPSMTQLLRR

SEQ ID NO: 2583 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDSAAEPPSMTQLLRR

SEQ ID NO: 2584 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDAGGEPPSMTQLLRR

SEQ ID NO: 2585 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDAGSEPPSMTQLLRR

SEQ ID NO: 2586 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDAGAEPPSMTQLLRR

SEQ ID NO: 2587 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDASGEPPSMTQLLRR

SEQ ID NO: 2588 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDASSEPPSMTQLLRR

SEQ ID NO: 2589 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDASAEPPSMTQLLRR

SEQ ID NO: 2590 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDAAGEPPSMTQLLRR

SEQ ID NO: 2591 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDAASEPPSMTQLLRR

SEQ ID NO: 2592 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKDGVSNKDIEKETAKDAAAEPPSMTQLLRR

SEQ ID NO: 2593 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDGGGEPPSMTQLLRR

SEQ ID NO: 2594 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDGGSEPPSMTQLLRR

SEQ ID NO: 2595 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDGGAEPPSMTQLLRR

SEQ ID NO: 2596 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDGSGEPPSMTQLLRR

SEQ ID NO: 2597 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDGSSEPPSMTQLLRR

SEQ ID NO: 2598 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDGSAEPPSMTQLLRR

SEQ ID NO: 2599 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDGAGEPPSMTQLLRR

SEQ ID NO: 2600 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDGASEPPSMTQLLRR

SEQ ID NO: 2601 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDGAAEPPSMTQLLRR

SEQ ID NO: 2602 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDSGGEPPSMTQLLRR

SEQ ID NO: 2603 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDSGSEPPSMTQLLRR

SEQ ID NO: 2604 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDSGAEPPSMTQLLRR

SEQ ID NO: 2605 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDSSGEPPSMTQLLRR

SEQ ID NO: 2606 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDSSSEPPSMTQLLRR

SEQ ID NO: 2607 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDSSAEPPSMTQLLRR

SEQ ID NO: 2608 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDSAGEPPSMTQLLRR

SEQ ID NO: 2609 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDSASEPPSMTQLLRR

SEQ ID NO: 2610 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDSAAEPPSMTQLLRR

SEQ ID NO: 2611 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDAGGEPPSMTQLLRR

SEQ ID NO: 2612 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDAGSEPPSMTQLLRR

SEQ ID NO: 2613 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDAGAEPPSMTQLLRR

SEQ ID NO: 2614 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDASGEPPSMTQLLRR

SEQ ID NO: 2615 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDASSEPPSMTQLLRR

SEQ ID NO: 2616 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDASAEPPSMTQLLRR

SEQ ID NO: 2617 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDAAGEPPSMTQLLRR

SEQ ID NO: 2618 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDAASEPPSMTQLLRR

SEQ ID NO: 2619 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKHGVSNKDIEKETAKDAAAEPPSMTQLLRR

SEQ ID NO: 2620 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDGGGEPPSMTQLLRR

SEQ ID NO: 2621 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDGGSEPPSMTQLLRR

SEQ ID NO: 2622 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDGGAEPPSMTQLLRR

SEQ ID NO: 2623 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDGSGEPPSMTQLLRR

SEQ ID NO: 2624 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDGSSEPPSMTQLLRR

SEQ ID NO: 2625 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDGSAEPPSMTQLLRR

SEQ ID NO: 2626 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDGAGEPPSMTQLLRR

SEQ ID NO: 2627 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDGASEPPSMTQLLRR

SEQ ID NO: 2628 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDGAAEPPSMTQLLRR

SEQ ID NO: 2629 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDSGGEPPSMTQLLRR

SEQ ID NO: 2630 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDSGSEPPSMTQLLRR

SEQ ID NO: 2631 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDSGAEPPSMTQLLRR

SEQ ID NO: 2632 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDSSGEPPSMTQLLRR

SEQ ID NO: 2633 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDSSSEPPSMTQLLRR

SEQ ID NO: 2634 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDSSAEPPSMTQLLRR

SEQ ID NO: 2635 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDSAGEPPSMTQLLRR

SEQ ID NO: 2636 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDSASEPPSMTQLLRR

SEQ ID NO: 2637 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDSAAEPPSMTQLLRR

SEQ ID NO: 2638 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDAGGEPPSMTQLLRR

SEQ ID NO: 2639 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDAGSEPPSMTQLLRR

SEQ ID NO: 2640 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDAGAEPPSMTQLLRR

SEQ ID NO: 2641 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDASGEPPSMTQLLRR

SEQ ID NO: 2642 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDASSEPPSMTQLLRR

SEQ ID NO: 2643 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDASAEPPSMTQLLRR

SEQ ID NO: 2644 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDAAGEPPSMTQLLRR

SEQ ID NO: 2645 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDAASEPPSMTQLLRR

SEQ ID NO: 2646 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKYGVSNKDIEKETAKDAAAEPPSMTQLLRR

SEQ ID NO: 2647 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDGGGEPPSMTQLLRR

SEQ ID NO: 2648 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDGGSEPPSMTQLLRR

SEQ ID NO: 2649 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDGGAEPPSMTQLLRR

SEQ ID NO: 2650 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDGSGEPPSMTQLLRR

SEQ ID NO: 2651 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDGSSEPPSMTQLLRR

SEQ ID NO: 2652 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDGSAEPPSMTQLLRR

SEQ ID NO: 2653 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDGAGEPPSMTQLLRR

SEQ ID NO: 2654 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDGASEPPSMTQLLRR

SEQ ID NO: 2655 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDGAAEPPSMTQLLRR

SEQ ID NO: 2656 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDSGGEPPSMTQLLRR

SEQ ID NO: 2657 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDSGSEPPSMTQLLRR

SEQ ID NO: 2658 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDSGAEPPSMTQLLRR

SEQ ID NO: 2659 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDSSGEPPSMTQLLRR

SEQ ID NO: 2660 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDSSSEPPSMTQLLRR

SEQ ID NO: 2661 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDSSAEPPSMTQLLRR

SEQ ID NO: 2662 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDSAGEPPSMTQLLRR

SEQ ID NO: 2663 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDSASEPPSMTQLLRR

SEQ ID NO: 2664 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDSAAEPPSMTQLLRR

SEQ ID NO: 2665 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDAGGEPPSMTQLLRR

SEQ ID NO: 2666 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDAGSEPPSMTQLLRR

SEQ ID NO: 2667 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDAGAEPPSMTQLLRR

SEQ ID NO: 2668 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDASGEPPSMTQLLRR

SEQ ID NO: 2669 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDASSEPPSMTQLLRR

SEQ ID NO: 2670 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDASAEPPSMTQLLRR

SEQ ID NO: 2671 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDAAGEPPSMTQLLRR

SEQ ID NO: 2672 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDAASEPPSMTQLLRR

SEQ ID NO: 2673 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKKGVSNKDIEKETAKDAAAEPPSMTQLLRR

SEQ ID NO: 2674 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDGGGEPPSMTQLLRR

SEQ ID NO: 2675 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDGGSEPPSMTQLLRR

SEQ ID NO: 2676 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDGGAEPPSMTQLLRR

SEQ ID NO: 2677 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDGSGEPPSMTQLLRR

SEQ ID NO: 2678 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDGSSEPPSMTQLLRR

SEQ ID NO: 2679 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDGSAEPPSMTQLLRR

SEQ ID NO: 2680 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDGAGEPPSMTQLLRR

SEQ ID NO: 2681 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDGASEPPSMTQLLRR

SEQ ID NO: 2682 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDGAAEPPSMTQLLRR

SEQ ID NO: 2683 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDSGGEPPSMTQLLRR

SEQ ID NO: 2684 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDSGSEPPSMTQLLRR

SEQ ID NO: 2685 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDSGAEPPSMTQLLRR

SEQ ID NO: 2686 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDSSGEPPSMTQLLRR

SEQ ID NO: 2687 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDSSSEPPSMTQLLRR

SEQ ID NO: 2688 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDSSAEPPSMTQLLRR

SEQ ID NO: 2689 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDSAGEPPSMTQLLRR

SEQ ID NO: 2690 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDSASEPPSMTQLLRR

SEQ ID NO: 2691 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDSAAEPPSMTQLLRR

SEQ ID NO: 2692 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDAGGEPPSMTQLLRR

SEQ ID NO: 2693 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDAGSEPPSMTQLLRR

SEQ ID NO: 2694 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDAGAEPPSMTQLLRR

SEQ ID NO: 2695 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDASGEPPSMTQLLRR

SEQ ID NO: 2696 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDASSEPPSMTQLLRR

SEQ ID NO: 2697 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDASAEPPSMTQLLRR

SEQ ID NO: 2698 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDAAGEPPSMTQLLRR

SEQ ID NO: 2699 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDAASEPPSMTQLLRR

SEQ ID NO: 2700 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKNGVSNKDIEKETAKDAAAEPPSMTQLLRR

SEQ ID NO: 2701 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDGGGEPPSMTQLLRR

SEQ ID NO: 2702 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDGGSEPPSMTQLLRR

SEQ ID NO: 2703 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDGGAEPPSMTQLLRR

SEQ ID NO: 2704 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDGSGEPPSMTQLLRR

SEQ ID NO: 2705 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDGSSEPPSMTQLLRR

SEQ ID NO: 2706 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDGSAEPPSMTQLLRR

SEQ ID NO: 2707 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDGAGEPPSMTQLLRR

SEQ ID NO: 2708 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDGASEPPSMTQLLRR

SEQ ID NO: 2709 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDGAAEPPSMTQLLRR

SEQ ID NO: 2710 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDSGGEPPSMTQLLRR

SEQ ID NO: 2711 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDSGSEPPSMTQLLRR

SEQ ID NO: 2712 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDSGAEPPSMTQLLRR

SEQ ID NO: 2713 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDSSGEPPSMTQLLRR

SEQ ID NO: 2714 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDSSSEPPSMTQLLRR

SEQ ID NO: 2715 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDSSAEPPSMTQLLRR

SEQ ID NO: 2716 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDSAGEPPSMTQLLRR

SEQ ID NO: 2717 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDSASEPPSMTQLLRR

SEQ ID NO: 2718 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDSAAEPPSMTQLLRR

SEQ ID NO: 2719 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDAGGEPPSMTQLLRR

SEQ ID NO: 2720 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDAGSEPPSMTQLLRR

SEQ ID NO: 2721 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDAGAEPPSMTQLLRR

SEQ ID NO: 2722 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDASGEPPSMTQLLRR

SEQ ID NO: 2723 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDASSEPPSMTQLLRR

SEQ ID NO: 2724 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDASAEPPSMTQLLRR

SEQ ID NO: 2725 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDAAGEPPSMTQLLRR

SEQ ID NO: 2726 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDAASEPPSMTQLLRR

SEQ ID NO: 2727 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDMFGLRGLLHLENASYGIEPLQNSSHFEHIIYRMDDVYKEPLKMGVSNKDIEKETAKDAAAEPPSMTQLLRR

SEQ ID NO: 2728 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDGGGEPPSMTQLLRR

SEQ ID NO: 2729 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDGGSEPPSMTQLLRR

SEQ ID NO: 2730 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDGGAEPPSMTQLLRR

SEQ ID NO: 2731 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDGSGEPPSMTQLLRR

SEQ ID NO: 2732 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDGSSEPPSMTQLLRR

SEQ ID NO: 2733 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDGSAEPPSMTQLLRR

SEQ ID NO: 2734 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDGAGEPPSMTQLLRR

SEQ ID NO: 2735 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDGASEPPSMTQLLRR

SEQ ID NO: 2736 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDGAAEPPSMTQLLRR

SEQ ID NO: 2737 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDSGGEPPSMTQLLRR

SEQ ID NO: 2738 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDSGSEPPSMTQLLRR

SEQ ID NO: 2739 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDSGAEPPSMTQLLRR

SEQ ID NO: 2740 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDSSGEPPSMTQLLRR

SEQ ID NO: 2741 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDSSSEPPSMTQLLRR

SEQ ID NO: 2742 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDSSAEPPSMTQLLRR

SEQ ID NO: 2743 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDSAGEPPSMTQLLRR

SEQ ID NO: 2744 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDSASEPPSMTQLLRR

SEQ ID NO: 2745 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDSAAEPPSMTQLLRR

SEQ ID NO: 2746 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDAGGEPPSMTQLLRR

SEQ ID NO: 2747 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDAGSEPPSMTQLLRR

SEQ ID NO: 2748 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDAGAEPPSMTQLLRR

SEQ ID NO: 2749 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDASGEPPSMTQLLRR

SEQ ID NO: 2750 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDASSEPPSMTQLLRR

SEQ ID NO: 2751 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDASAEPPSMTQLLRR

SEQ ID NO: 2752 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDAAGEPPSMTQLLRR

SEQ ID NO: 2753 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDAASEPPSMTQLLRR

SEQ ID NO: 2754 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKCGVSNKDIEKETAKDAAAEPPSMTQLLRR

SEQ ID NO: 2755 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDGGGEPPSMTQLLRR

SEQ ID NO: 2756 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDGGSEPPSMTQLLRR

SEQ ID NO: 2757 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDGGAEPPSMTQLLRR

SEQ ID NO: 2758 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDGSGEPPSMTQLLRR

SEQ ID NO: 2759 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDGSSEPPSMTQLLRR

SEQ ID NO: 2760 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDGSAEPPSMTQLLRR

SEQ ID NO: 2761 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDGAGEPPSMTQLLRR

SEQ ID NO: 2762 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDGASEPPSMTQLLRR

SEQ ID NO: 2763 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDGAAEPPSMTQLLRR

SEQ ID NO: 2764 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDSGGEPPSMTQLLRR

SEQ ID NO: 2765 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDSGSEPPSMTQLLRR

SEQ ID NO: 2766 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDSGAEPPSMTQLLRR

SEQ ID NO: 2767 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDSSGEPPSMTQLLRR

SEQ ID NO: 2768 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDSSSEPPSMTQLLRR

SEQ ID NO: 2769 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDSSAEPPSMTQLLRR

SEQ ID NO: 2770 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDSAGEPPSMTQLLRR

SEQ ID NO: 2771 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDSASEPPSMTQLLRR

SEQ ID NO: 2772 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDSAAEPPSMTQLLRR

SEQ ID NO: 2773 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDAGGEPPSMTQLLRR

SEQ ID NO: 2774 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDAGSEPPSMTQLLRR

SEQ ID NO: 2775 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDAGAEPPSMTQLLRR

SEQ ID NO: 2776 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDASGEPPSMTQLLRR

SEQ ID NO: 2777 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDASSEPPSMTQLLRR

SEQ ID NO: 2778 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDASAEPPSMTQLLRR

SEQ ID NO: 2779 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDAAGEPPSMTQLLRR

SEQ ID NO: 2780 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDAASEPPSMTQLLRR

SEQ ID NO: 2781 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKSGVSNKDIEKETAKDAAAEPPSMTQLLRR

SEQ ID NO: 2782 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDGGGEPPSMTQLLRR

SEQ ID NO: 2783 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDGGSEPPSMTQLLRR

SEQ ID NO: 2784 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDGGAEPPSMTQLLRR

SEQ ID NO: 2785 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDGSGEPPSMTQLLRR

SEQ ID NO: 2786 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDGSSEPPSMTQLLRR

SEQ ID NO: 2787 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDGSAEPPSMTQLLRR

SEQ ID NO: 2788 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDGAGEPPSMTQLLRR

SEQ ID NO: 2789 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDGASEPPSMTQLLRR

SEQ ID NO: 2790 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDGAAEPPSMTQLLRR

SEQ ID NO: 2791 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDSGGEPPSMTQLLRR

SEQ ID NO: 2792 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDSGSEPPSMTQLLRR

SEQ ID NO: 2793 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDSGAEPPSMTQLLRR

SEQ ID NO: 2794 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDSSGEPPSMTQLLRR

SEQ ID NO: 2795 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDSSSEPPSMTQLLRR

SEQ ID NO: 2796 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDSSAEPPSMTQLLRR

SEQ ID NO: 2797 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDSAGEPPSMTQLLRR

SEQ ID NO: 2798 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDSASEPPSMTQLLRR

SEQ ID NO: 2799 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDSAAEPPSMTQLLRR

SEQ ID NO: 2800 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDAGGEPPSMTQLLRR

SEQ ID NO: 2801 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDAGSEPPSMTQLLRR

SEQ ID NO: 2802 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDAGAEPPSMTQLLRR

SEQ ID NO: 2803 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDASGEPPSMTQLLRR

SEQ ID NO: 2804 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDASSEPPSMTQLLRR

SEQ ID NO: 2805 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDASAEPPSMTQLLRR

SEQ ID NO: 2806 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDAAGEPPSMTQLLRR

SEQ ID NO: 2807 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDAASEPPSMTQLLRR

SEQ ID NO: 2808 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKAGVSNKDIEKETAKDAAAEPPSMTQLLRR

SEQ ID NO: 2809 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDGGGEPPSMTQLLRR

SEQ ID NO: 2810 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDGGSEPPSMTQLLRR

SEQ ID NO: 2811 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDGGAEPPSMTQLLRR

SEQ ID NO: 2812 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDGSGEPPSMTQLLRR

SEQ ID NO: 2813 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDGSSEPPSMTQLLRR

SEQ ID NO: 2814 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDGSAEPPSMTQLLRR

SEQ ID NO: 2815 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDGAGEPPSMTQLLRR

SEQ ID NO: 2816 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDGASEPPSMTQLLRR

SEQ ID NO: 2817 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDGAAEPPSMTQLLRR

SEQ ID NO: 2818 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDSGGEPPSMTQLLRR

SEQ ID NO: 2819 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDSGSEPPSMTQLLRR

SEQ ID NO: 2820 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDSGAEPPSMTQLLRR

SEQ ID NO: 2821 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDSSGEPPSMTQLLRR

SEQ ID NO: 2822 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDSSSEPPSMTQLLRR

SEQ ID NO: 2823 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDSSAEPPSMTQLLRR

SEQ ID NO: 2824 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDSAGEPPSMTQLLRR

SEQ ID NO: 2825 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDSASEPPSMTQLLRR

SEQ ID NO: 2826 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDSAAEPPSMTQLLRR

SEQ ID NO: 2827 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDAGGEPPSMTQLLRR

SEQ ID NO: 2828 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDAGSEPPSMTQLLRR

SEQ ID NO: 2829 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDAGAEPPSMTQLLRR

SEQ ID NO: 2830 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDASGEPPSMTQLLRR

SEQ ID NO: 2831 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDASSEPPSMTQLLRR

SEQ ID NO: 2832 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDASAEPPSMTQLLRR

SEQ ID NO: 2833 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDAAGEPPSMTQLLRR

SEQ ID NO: 2834 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDAASEPPSMTQLLRR

SEQ ID NO: 2835 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKGGVSNKDIEKETAKDAAAEPPSMTQLLRR

SEQ ID NO: 2836 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDGGGEPPSMTQLLRR

SEQ ID NO: 2837 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDGGSEPPSMTQLLRR

SEQ ID NO: 2838 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDGGAEPPSMTQLLRR

SEQ ID NO: 2839 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDGSGEPPSMTQLLRR

SEQ ID NO: 2840 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDGSSEPPSMTQLLRR

SEQ ID NO: 2841 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDGSAEPPSMTQLLRR

SEQ ID NO: 2842 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDGAGEPPSMTQLLRR

SEQ ID NO: 2843 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDGASEPPSMTQLLRR

SEQ ID NO: 2844 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDGAAEPPSMTQLLRR

SEQ ID NO: 2845 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDSGGEPPSMTQLLRR

SEQ ID NO: 2846 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDSGSEPPSMTQLLRR

SEQ ID NO: 2847 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDSGAEPPSMTQLLRR

SEQ ID NO: 2848 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDSSGEPPSMTQLLRR

SEQ ID NO: 2849 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDSSSEPPSMTQLLRR

SEQ ID NO: 2850 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDSSAEPPSMTQLLRR

SEQ ID NO: 2851 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDSAGEPPSMTQLLRR

SEQ ID NO: 2852 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDSASEPPSMTQLLRR

SEQ ID NO: 2853 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDSAAEPPSMTQLLRR

SEQ ID NO: 2854 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDAGGEPPSMTQLLRR

SEQ ID NO: 2855 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDAGSEPPSMTQLLRR

SEQ ID NO: 2856 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDAGAEPPSMTQLLRR

SEQ ID NO: 2857 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDASGEPPSMTQLLRR

SEQ ID NO: 2858 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDASSEPPSMTQLLRR

SEQ ID NO: 2859 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDASAEPPSMTQLLRR

SEQ ID NO: 2860 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDAAGEPPSMTQLLRR

SEQ ID NO: 2861 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDAASEPPSMTQLLRR

SEQ ID NO: 2862 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKDGVSNKDIEKETAKDAAAEPPSMTQLLRR

SEQ ID NO: 2863 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDGGGEPPSMTQLLRR

SEQ ID NO: 2864 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDGGSEPPSMTQLLRR

SEQ ID NO: 2865 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDGGAEPPSMTQLLRR

SEQ ID NO: 2866 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDGSGEPPSMTQLLRR

SEQ ID NO: 2867 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDGSSEPPSMTQLLRR

SEQ ID NO: 2868 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDGSAEPPSMTQLLRR

SEQ ID NO: 2869 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDGAGEPPSMTQLLRR

SEQ ID NO: 2870 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDGASEPPSMTQLLRR

SEQ ID NO: 2871 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDGAAEPPSMTQLLRR

SEQ ID NO: 2872 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDSGGEPPSMTQLLRR

SEQ ID NO: 2873 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDSGSEPPSMTQLLRR

SEQ ID NO: 2874 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDSGAEPPSMTQLLRR

SEQ ID NO: 2875 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDSSGEPPSMTQLLRR

SEQ ID NO: 2876 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDSSSEPPSMTQLLRR

SEQ ID NO: 2877 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDSSAEPPSMTQLLRR

SEQ ID NO: 2878 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDSAGEPPSMTQLLRR

SEQ ID NO: 2879 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDSASEPPSMTQLLRR

SEQ ID NO: 2880 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDSAAEPPSMTQLLRR

SEQ ID NO: 2881 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDAGGEPPSMTQLLRR

SEQ ID NO: 2882 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDAGSEPPSMTQLLRR

SEQ ID NO: 2883 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDAGAEPPSMTQLLRR

SEQ ID NO: 2884 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDASGEPPSMTQLLRR

SEQ ID NO: 2885 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDASSEPPSMTQLLRR

SEQ ID NO: 2886 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDASAEPPSMTQLLRR

SEQ ID NO: 2887 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDAAGEPPSMTQLLRR

SEQ ID NO: 2888 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDAASEPPSMTQLLRR

SEQ ID NO: 2889 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKHGVSNKDIEKETAKDAAAEPPSMTQLLRR

SEQ ID NO: 2890 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDGGGEPPSMTQLLRR

SEQ ID NO: 2891 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDGGSEPPSMTQLLRR

SEQ ID NO: 2892 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDGGAEPPSMTQLLRR

SEQ ID NO: 2893 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDGSGEPPSMTQLLRR

SEQ ID NO: 2894 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDGSSEPPSMTQLLRR

SEQ ID NO: 2895 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDGSAEPPSMTQLLRR

SEQ ID NO: 2896 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDGAGEPPSMTQLLRR

SEQ ID NO: 2897 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDGASEPPSMTQLLRR

SEQ ID NO: 2898 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDGAAEPPSMTQLLRR

SEQ ID NO: 2899 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDSGGEPPSMTQLLRR

SEQ ID NO: 2900 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDSGSEPPSMTQLLRR

SEQ ID NO: 2901 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDSGAEPPSMTQLLRR

SEQ ID NO: 2902 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDSSGEPPSMTQLLRR

SEQ ID NO: 2903 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDSSSEPPSMTQLLRR

SEQ ID NO: 2904 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDSSAEPPSMTQLLRR

SEQ ID NO: 2905 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDSAGEPPSMTQLLRR

SEQ ID NO: 2906 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDSASEPPSMTQLLRR

SEQ ID NO: 2907 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDSAAEPPSMTQLLRR

SEQ ID NO: 2908 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDAGGEPPSMTQLLRR

SEQ ID NO: 2909 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDAGSEPPSMTQLLRR

SEQ ID NO: 2910 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDAGAEPPSMTQLLRR

SEQ ID NO: 2911 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDASGEPPSMTQLLRR

SEQ ID NO: 2912 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDASSEPPSMTQLLRR

SEQ ID NO: 2913 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDASAEPPSMTQLLRR

SEQ ID NO: 2914 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDAAGEPPSMTQLLRR

SEQ ID NO: 2915 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDAASEPPSMTQLLRR

SEQ ID NO: 2916 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKYGVSNKDIEKETAKDAAAEPPSMTQLLRR

SEQ ID NO: 2917 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDGGGEPPSMTQLLRR

SEQ ID NO: 2918 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDGGSEPPSMTQLLRR

SEQ ID NO: 2919 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDGGAEPPSMTQLLRR

SEQ ID NO: 2920 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDGSGEPPSMTQLLRR

SEQ ID NO: 2921 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDGSSEPPSMTQLLRR

SEQ ID NO: 2922 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDGSAEPPSMTQLLRR

SEQ ID NO: 2923 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDGAGEPPSMTQLLRR

SEQ ID NO: 2924 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDGASEPPSMTQLLRR

SEQ ID NO: 2925 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDGAAEPPSMTQLLRR

SEQ ID NO: 2926 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDSGGEPPSMTQLLRR

SEQ ID NO: 2927 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDSGSEPPSMTQLLRR

SEQ ID NO: 2928 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDSGAEPPSMTQLLRR

SEQ ID NO: 2929 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDSSGEPPSMTQLLRR

SEQ ID NO: 2930 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDSSSEPPSMTQLLRR

SEQ ID NO: 2931 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDSSAEPPSMTQLLRR

SEQ ID NO: 2932 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDSAGEPPSMTQLLRR

SEQ ID NO: 2933 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDSASEPPSMTQLLRR

SEQ ID NO: 2934 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDSAAEPPSMTQLLRR

SEQ ID NO: 2935 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDAGGEPPSMTQLLRR

SEQ ID NO: 2936 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDAGSEPPSMTQLLRR

SEQ ID NO: 2937 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDAGAEPPSMTQLLRR

SEQ ID NO: 2938 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDASGEPPSMTQLLRR

SEQ ID NO: 2939 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDASSEPPSMTQLLRR

SEQ ID NO: 2940 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDASAEPPSMTQLLRR

SEQ ID NO: 2941 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDAAGEPPSMTQLLRR

SEQ ID NO: 2942 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDAASEPPSMTQLLRR

SEQ ID NO: 2943 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKKGVSNKDIEKETAKDAAAEPPSMTQLLRR

SEQ ID NO: 2944 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDGGGEPPSMTQLLRR

SEQ ID NO: 2945 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDGGSEPPSMTQLLRR

SEQ ID NO: 2946 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDGGAEPPSMTQLLRR

SEQ ID NO: 2947 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDGSGEPPSMTQLLRR

SEQ ID NO: 2948 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDGSSEPPSMTQLLRR

SEQ ID NO: 2949 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDGSAEPPSMTQLLRR

SEQ ID NO: 2950 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDGAGEPPSMTQLLRR

SEQ ID NO: 2951 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDGASEPPSMTQLLRR

SEQ ID NO: 2952 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDGAAEPPSMTQLLRR

SEQ ID NO: 2953 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDSGGEPPSMTQLLRR

SEQ ID NO: 2954 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDSGSEPPSMTQLLRR

SEQ ID NO: 2955 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDSGAEPPSMTQLLRR

SEQ ID NO: 2956 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDSSGEPPSMTQLLRR

SEQ ID NO: 2957 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDSSSEPPSMTQLLRR

SEQ ID NO: 2958 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDSSAEPPSMTQLLRR

SEQ ID NO: 2959 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDSAGEPPSMTQLLRR

SEQ ID NO: 2960 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDSASEPPSMTQLLRR

SEQ ID NO: 2961 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDSAAEPPSMTQLLRR

SEQ ID NO: 2962 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDAGGEPPSMTQLLRR

SEQ ID NO: 2963 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDAGSEPPSMTQLLRR

SEQ ID NO: 2964 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDAGAEPPSMTQLLRR

SEQ ID NO: 2965 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDASGEPPSMTQLLRR

SEQ ID NO: 2966 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDASSEPPSMTQLLRR

SEQ ID NO: 2967 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDASAEPPSMTQLLRR

SEQ ID NO: 2968 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDAAGEPPSMTQLLRR

SEQ ID NO: 2969 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDAASEPPSMTQLLRR

SEQ ID NO: 2970 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKNGVSNKDIEKETAKDAAAEPPSMTQLLRR

SEQ ID NO: 2971 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDGGGEPPSMTQLLRR

SEQ ID NO: 2972 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDGGSEPPSMTQLLRR

SEQ ID NO: 2973 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDGGAEPPSMTQLLRR

SEQ ID NO: 2974 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDGSGEPPSMTQLLRR

SEQ ID NO: 2975 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDGSSEPPSMTQLLRR

SEQ ID NO: 2976 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDGSAEPPSMTQLLRR

SEQ ID NO: 2977 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDGAGEPPSMTQLLRR

SEQ ID NO: 2978 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDGASEPPSMTQLLRR

SEQ ID NO: 2979 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDGAAEPPSMTQLLRR

SEQ ID NO: 2980 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDSGGEPPSMTQLLRR

SEQ ID NO: 2981 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDSGSEPPSMTQLLRR

SEQ ID NO: 2982 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDSGAEPPSMTQLLRR

SEQ ID NO: 2983 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDSSGEPPSMTQLLRR

SEQ ID NO: 2984 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDSSSEPPSMTQLLRR

SEQ ID NO: 2985 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDSSAEPPSMTQLLRR

SEQ ID NO: 2986 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDSAGEPPSMTQLLRR

SEQ ID NO: 2987 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDSASEPPSMTQLLRR

SEQ ID NO: 2988 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDSAAEPPSMTQLLRR

SEQ ID NO: 2989 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDAGGEPPSMTQLLRR

SEQ ID NO: 2990 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDAGSEPPSMTQLLRR

SEQ ID NO: 2991 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDAGAEPPSMTQLLRR

SEQ ID NO: 2992 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDASGEPPSMTQLLRR

SEQ ID NO: 2993 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDASSEPPSMTQLLRR

SEQ ID NO: 2994 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDASAEPPSMTQLLRR

SEQ ID NO: 2995 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDAAGEPPSMTQLLRR

SEQ ID NO: 2996 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDAASEPPSMTQLLRR

SEQ ID NO: 2997 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDCFGLRGLLHLENASYGIEPLQNSSHFEHIIYRMDDVYKEPLKMGVSNKDIEKETAKDAAAEPPSMTQLLRR

SEQ ID NO: 2998 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDGGGEPPSMTQLLRR

SEQ ID NO: 2999 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDGGSEPPSMTQLLRR

SEQ ID NO: 3000 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDGGAEPPSMTQLLRR

SEQ ID NO: 3001 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDGSGEPPSMTQLLRR

SEQ ID NO: 3002 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDGSSEPPSMTQLLRR

SEQ ID NO: 3003 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDGSAEPPSMTQLLRR

SEQ ID NO: 3004 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDGAGEPPSMTQLLRR

SEQ ID NO: 3005 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDGASEPPSMTQLLRR

SEQ ID NO: 3006 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDGAAEPPSMTQLLRR

SEQ ID NO: 3007 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDSGGEPPSMTQLLRR

SEQ ID NO: 3008 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDSGSEPPSMTQLLRR

SEQ ID NO: 3009 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDSGAEPPSMTQLLRR

SEQ ID NO: 3010 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDSSGEPPSMTQLLRR

SEQ ID NO: 3011 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDSSSEPPSMTQLLRR

SEQ ID NO: 3012 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDSSAEPPSMTQLLRR

SEQ ID NO: 3013 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDSAGEPPSMTQLLRR

SEQ ID NO: 3014 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDSASEPPSMTQLLRR

SEQ ID NO: 3015 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDSAAEPPSMTQLLRR

SEQ ID NO: 3016 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDAGGEPPSMTQLLRR

SEQ ID NO: 3017 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDAGSEPPSMTQLLRR

SEQ ID NO: 3018 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDAGAEPPSMTQLLRR

SEQ ID NO: 3019 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDASGEPPSMTQLLRR

SEQ ID NO: 3020 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDASSEPPSMTQLLRR

SEQ ID NO: 3021 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDASAEPPSMTQLLRR

SEQ ID NO: 3022 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDAAGEPPSMTQLLRR

SEQ ID NO: 3023 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDAASEPPSMTQLLRR

SEQ ID NO: 3024 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKCGVSNKDIEKETAKDAAAEPPSMTQLLRR

SEQ ID NO: 3025 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDGGGEPPSMTQLLRR

SEQ ID NO: 3026 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDGGSEPPSMTQLLRR

SEQ ID NO: 3027 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDGGAEPPSMTQLLRR

SEQ ID NO: 3028 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDGSGEPPSMTQLLRR

SEQ ID NO: 3029 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDGSSEPPSMTQLLRR

SEQ ID NO: 3030 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDGSAEPPSMTQLLRR

SEQ ID NO: 3031 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDGAGEPPSMTQLLRR

SEQ ID NO: 3032 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDGASEPPSMTQLLRR

SEQ ID NO: 3033 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDGAAEPPSMTQLLRR

SEQ ID NO: 3034 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDSGGEPPSMTQLLRR

SEQ ID NO: 3035 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDSGSEPPSMTQLLRR

SEQ ID NO: 3036 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDSGAEPPSMTQLLRR

SEQ ID NO: 3037 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDSSGEPPSMTQLLRR

SEQ ID NO: 3038 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDSSSEPPSMTQLLRR

SEQ ID NO: 3039 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDSSAEPPSMTQLLRR

SEQ ID NO: 3040 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDSAGEPPSMTQLLRR

SEQ ID NO: 3041 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDSASEPPSMTQLLRR

SEQ ID NO: 3042 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDSAAEPPSMTQLLRR

SEQ ID NO: 3043 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDAGGEPPSMTQLLRR

SEQ ID NO: 3044 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDAGSEPPSMTQLLRR

SEQ ID NO: 3045 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDAGAEPPSMTQLLRR

SEQ ID NO: 3046 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDASGEPPSMTQLLRR

SEQ ID NO: 3047 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDASSEPPSMTQLLRR

SEQ ID NO: 3048 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDASAEPPSMTQLLRR

SEQ ID NO: 3049 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDAAGEPPSMTQLLRR

SEQ ID NO: 3050 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDAASEPPSMTQLLRR

SEQ ID NO: 3051 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKSGVSNKDIEKETAKDAAAEPPSMTQLLRR

SEQ ID NO: 3052 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDGGGEPPSMTQLLRR

SEQ ID NO: 3053 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDGGSEPPSMTQLLRR

SEQ ID NO: 3054 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDGGAEPPSMTQLLRR

SEQ ID NO: 3055 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDGSGEPPSMTQLLRR

SEQ ID NO: 3056 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDGSSEPPSMTQLLRR

SEQ ID NO: 3057 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDGSAEPPSMTQLLRR

SEQ ID NO: 3058 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDGAGEPPSMTQLLRR

SEQ ID NO: 3059 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDGASEPPSMTQLLRR

SEQ ID NO: 3060 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDGAAEPPSMTQLLRR

SEQ ID NO: 3061 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDSGGEPPSMTQLLRR

SEQ ID NO: 3062 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDSGSEPPSMTQLLRR

SEQ ID NO: 3063 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDSGAEPPSMTQLLRR

SEQ ID NO: 3064 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDSSGEPPSMTQLLRR

SEQ ID NO: 3065 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDSSSEPPSMTQLLRR

SEQ ID NO: 3066 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDSSAEPPSMTQLLRR

SEQ ID NO: 3067 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDSAGEPPSMTQLLRR

SEQ ID NO: 3068 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDSASEPPSMTQLLRR

SEQ ID NO: 3069 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDSAAEPPSMTQLLRR

SEQ ID NO: 3070 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDAGGEPPSMTQLLRR

SEQ ID NO: 3071 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDAGSEPPSMTQLLRR

SEQ ID NO: 3072 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDAGAEPPSMTQLLRR

SEQ ID NO: 3073 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDASGEPPSMTQLLRR

SEQ ID NO: 3074 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDASSEPPSMTQLLRR

SEQ ID NO: 3075 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDASAEPPSMTQLLRR

SEQ ID NO: 3076 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDAAGEPPSMTQLLRR

SEQ ID NO: 3077 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDAASEPPSMTQLLRR

SEQ ID NO: 3078 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKAGVSNKDIEKETAKDAAAEPPSMTQLLRR

SEQ ID NO: 3079 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDGGGEPPSMTQLLRR

SEQ ID NO: 3080 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDGGSEPPSMTQLLRR

SEQ ID NO: 3081 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDGGAEPPSMTQLLRR

SEQ ID NO: 3082 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDGSGEPPSMTQLLRR

SEQ ID NO: 3083 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDGSSEPPSMTQLLRR

SEQ ID NO: 3084 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDGSAEPPSMTQLLRR

SEQ ID NO: 3085 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDGAGEPPSMTQLLRR

SEQ ID NO: 3086 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDGASEPPSMTQLLRR

SEQ ID NO: 3087 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDGAAEPPSMTQLLRR

SEQ ID NO: 3088 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDSGGEPPSMTQLLRR

SEQ ID NO: 3089 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDSGSEPPSMTQLLRR

SEQ ID NO: 3090 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDSGAEPPSMTQLLRR

SEQ ID NO: 3091 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDSSGEPPSMTQLLRR

SEQ ID NO: 3092 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDSSSEPPSMTQLLRR

SEQ ID NO: 3093 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDSSAEPPSMTQLLRR

SEQ ID NO: 3094 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDSAGEPPSMTQLLRR

SEQ ID NO: 3095 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDSASEPPSMTQLLRR

SEQ ID NO: 3096 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDSAAEPPSMTQLLRR

SEQ ID NO: 3097 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDAGGEPPSMTQLLRR

SEQ ID NO: 3098 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDAGSEPPSMTQLLRR

SEQ ID NO: 3099 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDAGAEPPSMTQLLRR

SEQ ID NO: 3100 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDASGEPPSMTQLLRR

SEQ ID NO: 3101 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDASSEPPSMTQLLRR

SEQ ID NO: 3102 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDASAEPPSMTQLLRR

SEQ ID NO: 3103 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDAAGEPPSMTQLLRR

SEQ ID NO: 3104 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDAASEPPSMTQLLRR

SEQ ID NO: 3105 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKGGVSNKDIEKETAKDAAAEPPSMTQLLRR

SEQ ID NO: 3106 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDGGGEPPSMTQLLRR

SEQ ID NO: 3107 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDGGSEPPSMTQLLRR

SEQ ID NO: 3108 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDGGAEPPSMTQLLRR

SEQ ID NO: 3109 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDGSGEPPSMTQLLRR

SEQ ID NO: 3110 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDGSSEPPSMTQLLRR

SEQ ID NO: 3111 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDGSAEPPSMTQLLRR

SEQ ID NO: 3112 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDGAGEPPSMTQLLRR

SEQ ID NO: 3113 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDGASEPPSMTQLLRR

SEQ ID NO: 3114 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDGAAEPPSMTQLLRR

SEQ ID NO: 3115 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDSGGEPPSMTQLLRR

SEQ ID NO: 3116 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDSGSEPPSMTQLLRR

SEQ ID NO: 3117 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDSGAEPPSMTQLLRR

SEQ ID NO: 3118 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDSSGEPPSMTQLLRR

SEQ ID NO: 3119 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDSSSEPPSMTQLLRR

SEQ ID NO: 3120 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDSSAEPPSMTQLLRR

SEQ ID NO: 3121 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDSAGEPPSMTQLLRR

SEQ ID NO: 3122 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDSASEPPSMTQLLRR

SEQ ID NO: 3123 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDSAAEPPSMTQLLRR

SEQ ID NO: 3124 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDAGGEPPSMTQLLRR

SEQ ID NO: 3125 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDAGSEPPSMTQLLRR

SEQ ID NO: 3126 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDAGAEPPSMTQLLRR

SEQ ID NO: 3127 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDASGEPPSMTQLLRR

SEQ ID NO: 3128 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDASSEPPSMTQLLRR

SEQ ID NO: 3129 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDASAEPPSMTQLLRR

SEQ ID NO: 3130 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDAAGEPPSMTQLLRR

SEQ ID NO: 3131 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDAASEPPSMTQLLRR

SEQ ID NO: 3132 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKDGVSNKDIEKETAKDAAAEPPSMTQLLRR

SEQ ID NO: 3133 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDGGGEPPSMTQLLRR

SEQ ID NO: 3134 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDGGSEPPSMTQLLRR

SEQ ID NO: 3135 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDGGAEPPSMTQLLRR

SEQ ID NO: 3136 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDGSGEPPSMTQLLRR

SEQ ID NO: 3137 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDGSSEPPSMTQLLRR

SEQ ID NO: 3138 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDGSAEPPSMTQLLRR

SEQ ID NO: 3139 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDGAGEPPSMTQLLRR

SEQ ID NO: 3140 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDGASEPPSMTQLLRR

SEQ ID NO: 3141 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDGAAEPPSMTQLLRR

SEQ ID NO: 3142 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDSGGEPPSMTQLLRR

SEQ ID NO: 3143 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDSGSEPPSMTQLLRR

SEQ ID NO: 3144 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDSGAEPPSMTQLLRR

SEQ ID NO: 3145 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDSSGEPPSMTQLLRR

SEQ ID NO: 3146 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDSSSEPPSMTQLLRR

SEQ ID NO: 3147 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDSSAEPPSMTQLLRR

SEQ ID NO: 3148 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDSAGEPPSMTQLLRR

SEQ ID NO: 3149 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDSASEPPSMTQLLRR

SEQ ID NO: 3150 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDSAAEPPSMTQLLRR

SEQ ID NO: 3151 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDAGGEPPSMTQLLRR

SEQ ID NO: 3152 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDAGSEPPSMTQLLRR

SEQ ID NO: 3153 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDAGAEPPSMTQLLRR

SEQ ID NO: 3154 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDASGEPPSMTQLLRR

SEQ ID NO: 3155 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDASSEPPSMTQLLRR

SEQ ID NO: 3156 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDASAEPPSMTQLLRR

SEQ ID NO: 3157 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDAAGEPPSMTQLLRR

SEQ ID NO: 3158 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDAASEPPSMTQLLRR

SEQ ID NO: 3159 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKHGVSNKDIEKETAKDAAAEPPSMTQLLRR

SEQ ID NO: 3160 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDGGGEPPSMTQLLRR

SEQ ID NO: 3161 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDGGSEPPSMTQLLRR

SEQ ID NO: 3162 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDGGAEPPSMTQLLRR

SEQ ID NO: 3163 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDGSGEPPSMTQLLRR

SEQ ID NO: 3164 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDGSSEPPSMTQLLRR

SEQ ID NO: 3165 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDGSAEPPSMTQLLRR

SEQ ID NO: 3166 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDGAGEPPSMTQLLRR

SEQ ID NO: 3167 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDGASEPPSMTQLLRR

SEQ ID NO: 3168 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDGAAEPPSMTQLLRR

SEQ ID NO: 3169 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDSGGEPPSMTQLLRR

SEQ ID NO: 3170 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDSGSEPPSMTQLLRR

SEQ ID NO: 3171 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDSGAEPPSMTQLLRR

SEQ ID NO: 3172 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDSSGEPPSMTQLLRR

SEQ ID NO: 3173 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDSSSEPPSMTQLLRR

SEQ ID NO: 3174 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDSSAEPPSMTQLLRR

SEQ ID NO: 3175 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDSAGEPPSMTQLLRR

SEQ ID NO: 3176 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDSASEPPSMTQLLRR

SEQ ID NO: 3177 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDSAAEPPSMTQLLRR

SEQ ID NO: 3178 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDAGGEPPSMTQLLRR

SEQ ID NO: 3179 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDAGSEPPSMTQLLRR

SEQ ID NO: 3180 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDAGAEPPSMTQLLRR

SEQ ID NO: 3181 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDASGEPPSMTQLLRR

SEQ ID NO: 3182 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDASSEPPSMTQLLRR

SEQ ID NO: 3183 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDASAEPPSMTQLLRR

SEQ ID NO: 3184 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDAAGEPPSMTQLLRR

SEQ ID NO: 3185 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDAASEPPSMTQLLRR

SEQ ID NO: 3186 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKYGVSNKDIEKETAKDAAAEPPSMTQLLRR

SEQ ID NO: 3187 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDGGGEPPSMTQLLRR

SEQ ID NO: 3188 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDGGSEPPSMTQLLRR

SEQ ID NO: 3189 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDGGAEPPSMTQLLRR

SEQ ID NO: 3190 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDGSGEPPSMTQLLRR

SEQ ID NO: 3191 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDGSSEPPSMTQLLRR

SEQ ID NO: 3192 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDGSAEPPSMTQLLRR

SEQ ID NO: 3193 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDGAGEPPSMTQLLRR

SEQ ID NO: 3194 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDGASEPPSMTQLLRR

SEQ ID NO: 3195 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDGAAEPPSMTQLLRR

SEQ ID NO: 3196 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDSGGEPPSMTQLLRR

SEQ ID NO: 3197 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDSGSEPPSMTQLLRR

SEQ ID NO: 3198 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDSGAEPPSMTQLLRR

SEQ ID NO: 3199 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDSSGEPPSMTQLLRR

SEQ ID NO: 3200 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDSSSEPPSMTQLLRR

SEQ ID NO: 3201 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDSSAEPPSMTQLLRR

SEQ ID NO: 3202 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDSAGEPPSMTQLLRR

SEQ ID NO: 3203 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDSASEPPSMTQLLRR

SEQ ID NO: 3204 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDSAAEPPSMTQLLRR

SEQ ID NO: 3205 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDAGGEPPSMTQLLRR

SEQ ID NO: 3206 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDAGSEPPSMTQLLRR

SEQ ID NO: 3207 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDAGAEPPSMTQLLRR

SEQ ID NO: 3208 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDASGEPPSMTQLLRR

SEQ ID NO: 3209 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDASSEPPSMTQLLRR

SEQ ID NO: 3210 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDASAEPPSMTQLLRR

SEQ ID NO: 3211 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDAAGEPPSMTQLLRR

SEQ ID NO: 3212 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDAASEPPSMTQLLRR

SEQ ID NO: 3213 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKKGVSNKDIEKETAKDAAAEPPSMTQLLRR

SEQ ID NO: 3214 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDGGGEPPSMTQLLRR

SEQ ID NO: 3215 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDGGSEPPSMTQLLRR

SEQ ID NO: 3216 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDGGAEPPSMTQLLRR

SEQ ID NO: 3217 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDGSGEPPSMTQLLRR

SEQ ID NO: 3218 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDGSSEPPSMTQLLRR

SEQ ID NO: 3219 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDGSAEPPSMTQLLRR

SEQ ID NO: 3220 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDGAGEPPSMTQLLRR

SEQ ID NO: 3221 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDGASEPPSMTQLLRR

SEQ ID NO: 3222 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDGAAEPPSMTQLLRR

SEQ ID NO: 3223 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDSGGEPPSMTQLLRR

SEQ ID NO: 3224 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDSGSEPPSMTQLLRR

SEQ ID NO: 3225 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDSGAEPPSMTQLLRR

SEQ ID NO: 3226 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDSSGEPPSMTQLLRR

SEQ ID NO: 3227 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDSSSEPPSMTQLLRR

SEQ ID NO: 3228 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDSSAEPPSMTQLLRR

SEQ ID NO: 3229 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDSAGEPPSMTQLLRR

SEQ ID NO: 3230 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDSASEPPSMTQLLRR

SEQ ID NO: 3231 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDSAAEPPSMTQLLRR

SEQ ID NO: 3232 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDAGGEPPSMTQLLRR

SEQ ID NO: 3233 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDAGSEPPSMTQLLRR

SEQ ID NO: 3234 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDAGAEPPSMTQLLRR

SEQ ID NO: 3235 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDASGEPPSMTQLLRR

SEQ ID NO: 3236 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDASSEPPSMTQLLRR

SEQ ID NO: 3237 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDASAEPPSMTQLLRR

SEQ ID NO: 3238 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDAAGEPPSMTQLLRR

SEQ ID NO: 3239 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDAASEPPSMTQLLRR

SEQ ID NO: 3240 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKNGVSNKDIEKETAKDAAAEPPSMTQLLRR

SEQ ID NO: 3241 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDGGGEPPSMTQLLRR

SEQ ID NO: 3242 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDGGSEPPSMTQLLRR

SEQ ID NO: 3243 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDGGAEPPSMTQLLRR

SEQ ID NO: 3244 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDGSGEPPSMTQLLRR

SEQ ID NO: 3245 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDGSSEPPSMTQLLRR

SEQ ID NO: 3246 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDGSAEPPSMTQLLRR

SEQ ID NO: 3247 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDGAGEPPSMTQLLRR

SEQ ID NO: 3248 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDGASEPPSMTQLLRR

SEQ ID NO: 3249 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDGAAEPPSMTQLLRR

SEQ ID NO: 3250 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDSGGEPPSMTQLLRR

SEQ ID NO: 3251 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDSGSEPPSMTQLLRR

SEQ ID NO: 3252 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDSGAEPPSMTQLLRR

SEQ ID NO: 3253 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDSSGEPPSMTQLLRR

SEQ ID NO: 3254 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDSSSEPPSMTQLLRR

SEQ ID NO: 3255 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDSSAEPPSMTQLLRR

SEQ ID NO: 3256 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDSAGEPPSMTQLLRR

SEQ ID NO: 3257 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDSASEPPSMTQLLRR

SEQ ID NO: 3258 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDSAAEPPSMTQLLRR

SEQ ID NO: 3259 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDAGGEPPSMTQLLRR

SEQ ID NO: 3260 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDAGSEPPSMTQLLRR

SEQ ID NO: 3261 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDAGAEPPSMTQLLRR

SEQ ID NO: 3262 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDASGEPPSMTQLLRR

SEQ ID NO: 3263 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDASSEPPSMTQLLRR

SEQ ID NO: 3264 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDASAEPPSMTQLLRR

SEQ ID NO: 3265 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDAAGEPPSMTQLLRR

SEQ ID NO: 3266 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDAASEPPSMTQLLRR

SEQ ID NO: 3267 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDSFGLRGLLHLENASYGIEPLQNSSHFEHIIYRMDDVYKEPLKMGVSNKDIEKETAKDAAAEPPSMTQLLRR

SEQ ID NO: 3268 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDGGGEPPSMTQLLRR

SEQ ID NO: 3269 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDGGSEPPSMTQLLRR

SEQ ID NO: 3270 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDGGAEPPSMTQLLRR

SEQ ID NO: 3271 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDGSGEPPSMTQLLRR

SEQ ID NO: 3272 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDGSSEPPSMTQLLRR

SEQ ID NO: 3273 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDGSAEPPSMTQLLRR

SEQ ID NO: 3274 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDGAGEPPSMTQLLRR

SEQ ID NO: 3275 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDGASEPPSMTQLLRR

SEQ ID NO: 3276 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDGAAEPPSMTQLLRR

SEQ ID NO: 3277 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDSGGEPPSMTQLLRR

SEQ ID NO: 3278 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDSGSEPPSMTQLLRR

SEQ ID NO: 3279 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDSGAEPPSMTQLLRR

SEQ ID NO: 3280 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDSSGEPPSMTQLLRR

SEQ ID NO: 3281 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDSSSEPPSMTQLLRR

SEQ ID NO: 3282 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDSSAEPPSMTQLLRR

SEQ ID NO: 3283 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDSAGEPPSMTQLLRR

SEQ ID NO: 3284 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDSASEPPSMTQLLRR

SEQ ID NO: 3285 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDSAAEPPSMTQLLRR

SEQ ID NO: 3286 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDAGGEPPSMTQLLRR

SEQ ID NO: 3287 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDAGSEPPSMTQLLRR

SEQ ID NO: 3288 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDAGAEPPSMTQLLRR

SEQ ID NO: 3289 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDASGEPPSMTQLLRR

SEQ ID NO: 3290 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDASSEPPSMTQLLRR

SEQ ID NO: 3291 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDASAEPPSMTQLLRR

SEQ ID NO: 3292 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDAAGEPPSMTQLLRR

SEQ ID NO: 3293 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDAASEPPSMTQLLRR

SEQ ID NO: 3294 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKCGVSNKDIEKETAKDAAAEPPSMTQLLRR

SEQ ID NO: 3295 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDGGGEPPSMTQLLRR

SEQ ID NO: 3296 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDGGSEPPSMTQLLRR

SEQ ID NO: 3297 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDGGAEPPSMTQLLRR

SEQ ID NO: 3298 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDGSGEPPSMTQLLRR

SEQ ID NO: 3299 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDGSSEPPSMTQLLRR

SEQ ID NO: 3300 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDGSAEPPSMTQLLRR

SEQ ID NO: 3301 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDGAGEPPSMTQLLRR

SEQ ID NO: 3302 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDGASEPPSMTQLLRR

SEQ ID NO: 3303 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDGAAEPPSMTQLLRR

SEQ ID NO: 3304 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDSGGEPPSMTQLLRR

SEQ ID NO: 3305 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDSGSEPPSMTQLLRR

SEQ ID NO: 3306 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDSGAEPPSMTQLLRR

SEQ ID NO: 3307 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDSSGEPPSMTQLLRR

SEQ ID NO: 3308 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDSSSEPPSMTQLLRR

SEQ ID NO: 3309 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDSSAEPPSMTQLLRR

SEQ ID NO: 3310 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDSAGEPPSMTQLLRR

SEQ ID NO: 3311 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDSASEPPSMTQLLRR

SEQ ID NO: 3312 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDSAAEPPSMTQLLRR

SEQ ID NO: 3313 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDAGGEPPSMTQLLRR

SEQ ID NO: 3314 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDAGSEPPSMTQLLRR

SEQ ID NO: 3315 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDAGAEPPSMTQLLRR

SEQ ID NO: 3316 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDASGEPPSMTQLLRR

SEQ ID NO: 3317 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDASSEPPSMTQLLRR

SEQ ID NO: 3318 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDASAEPPSMTQLLRR

SEQ ID NO: 3319 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDAAGEPPSMTQLLRR

SEQ ID NO: 3320 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDAASEPPSMTQLLRR

SEQ ID NO: 3321 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKSGVSNKDIEKETAKDAAAEPPSMTQLLRR

SEQ ID NO: 3322 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDGGGEPPSMTQLLRR

SEQ ID NO: 3323 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDGGSEPPSMTQLLRR

SEQ ID NO: 3324 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDGGAEPPSMTQLLRR

SEQ ID NO: 3325 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDGSGEPPSMTQLLRR

SEQ ID NO: 3326 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDGSSEPPSMTQLLRR

SEQ ID NO: 3327 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDGSAEPPSMTQLLRR

SEQ ID NO: 3328 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDGAGEPPSMTQLLRR

SEQ ID NO: 3329 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDGASEPPSMTQLLRR

SEQ ID NO: 3330 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDGAAEPPSMTQLLRR

SEQ ID NO: 3331 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDSGGEPPSMTQLLRR

SEQ ID NO: 3332 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDSGSEPPSMTQLLRR

SEQ ID NO: 3333 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDSGAEPPSMTQLLRR

SEQ ID NO: 3334 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDSSGEPPSMTQLLRR

SEQ ID NO: 3335 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDSSSEPPSMTQLLRR

SEQ ID NO: 3336 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDSSAEPPSMTQLLRR

SEQ ID NO: 3337 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDSAGEPPSMTQLLRR

SEQ ID NO: 3338 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDSASEPPSMTQLLRR

SEQ ID NO: 3339 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDSAAEPPSMTQLLRR

SEQ ID NO: 3340 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDAGGEPPSMTQLLRR

SEQ ID NO: 3341 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDAGSEPPSMTQLLRR

SEQ ID NO: 3342 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDAGAEPPSMTQLLRR

SEQ ID NO: 3343 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDASGEPPSMTQLLRR

SEQ ID NO: 3344 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDASSEPPSMTQLLRR

SEQ ID NO: 3345 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDASAEPPSMTQLLRR

SEQ ID NO: 3346 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDAAGEPPSMTQLLRR

SEQ ID NO: 3347 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDAASEPPSMTQLLRR

SEQ ID NO: 3348 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKAGVSNKDIEKETAKDAAAEPPSMTQLLRR

SEQ ID NO: 3349 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDGGGEPPSMTQLLRR

SEQ ID NO: 3350 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDGGSEPPSMTQLLRR

SEQ ID NO: 3351 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDGGAEPPSMTQLLRR

SEQ ID NO: 3352 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDGSGEPPSMTQLLRR

SEQ ID NO: 3353 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDGSSEPPSMTQLLRR

SEQ ID NO: 3354 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDGSAEPPSMTQLLRR

SEQ ID NO: 3355 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDGAGEPPSMTQLLRR

SEQ ID NO: 3356 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDGASEPPSMTQLLRR

SEQ ID NO: 3357 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDGAAEPPSMTQLLRR

SEQ ID NO: 3358 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDSGGEPPSMTQLLRR

SEQ ID NO: 3359 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDSGSEPPSMTQLLRR

SEQ ID NO: 3360 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDSGAEPPSMTQLLRR

SEQ ID NO: 3361 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDSSGEPPSMTQLLRR

SEQ ID NO: 3362 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDSSSEPPSMTQLLRR

SEQ ID NO: 3363 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDSSAEPPSMTQLLRR

SEQ ID NO: 3364 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDSAGEPPSMTQLLRR

SEQ ID NO: 3365 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDSASEPPSMTQLLRR

SEQ ID NO: 3366 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDSAAEPPSMTQLLRR

SEQ ID NO: 3367 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDAGGEPPSMTQLLRR

SEQ ID NO: 3368 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDAGSEPPSMTQLLRR

SEQ ID NO: 3369 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDAGAEPPSMTQLLRR

SEQ ID NO: 3370 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDASGEPPSMTQLLRR

SEQ ID NO: 3371 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDASSEPPSMTQLLRR

SEQ ID NO: 3372 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDASAEPPSMTQLLRR

SEQ ID NO: 3373 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDAAGEPPSMTQLLRR

SEQ ID NO: 3374 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDAASEPPSMTQLLRR

SEQ ID NO: 3375 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKGGVSNKDIEKETAKDAAAEPPSMTQLLRR

SEQ ID NO: 3376 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDGGGEPPSMTQLLRR

SEQ ID NO: 3377 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDGGSEPPSMTQLLRR

SEQ ID NO: 3378 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDGGAEPPSMTQLLRR

SEQ ID NO: 3379 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDGSGEPPSMTQLLRR

SEQ ID NO: 3380 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDGSSEPPSMTQLLRR

SEQ ID NO: 3381 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDGSAEPPSMTQLLRR

SEQ ID NO: 3382 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDGAGEPPSMTQLLRR

SEQ ID NO: 3383 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDGASEPPSMTQLLRR

SEQ ID NO: 3384 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDGAAEPPSMTQLLRR

SEQ ID NO: 3385 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDSGGEPPSMTQLLRR

SEQ ID NO: 3386 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDSGSEPPSMTQLLRR

SEQ ID NO: 3387 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDSGAEPPSMTQLLRR

SEQ ID NO: 3388 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDSSGEPPSMTQLLRR

SEQ ID NO: 3389 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDSSSEPPSMTQLLRR

SEQ ID NO: 3390 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDSSAEPPSMTQLLRR

SEQ ID NO: 3391 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDSAGEPPSMTQLLRR

SEQ ID NO: 3392 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDSASEPPSMTQLLRR

SEQ ID NO: 3393 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDSAAEPPSMTQLLRR

SEQ ID NO: 3394 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDAGGEPPSMTQLLRR

SEQ ID NO: 3395 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDAGSEPPSMTQLLRR

SEQ ID NO: 3396 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDAGAEPPSMTQLLRR

SEQ ID NO: 3397 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDASGEPPSMTQLLRR

SEQ ID NO: 3398 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDASSEPPSMTQLLRR

SEQ ID NO: 3399 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDASAEPPSMTQLLRR

SEQ ID NO: 3400 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDAAGEPPSMTQLLRR

SEQ ID NO: 3401 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDAASEPPSMTQLLRR

SEQ ID NO: 3402 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKDGVSNKDIEKETAKDAAAEPPSMTQLLRR

SEQ ID NO: 3403 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDGGGEPPSMTQLLRR

SEQ ID NO: 3404 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDGGSEPPSMTQLLRR

SEQ ID NO: 3405 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDGGAEPPSMTQLLRR

SEQ ID NO: 3406 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDGSGEPPSMTQLLRR

SEQ ID NO: 3407 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDGSSEPPSMTQLLRR

SEQ ID NO: 3408 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDGSAEPPSMTQLLRR

SEQ ID NO: 3409 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDGAGEPPSMTQLLRR

SEQ ID NO: 3410 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDGASEPPSMTQLLRR

SEQ ID NO: 3411 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDGAAEPPSMTQLLRR

SEQ ID NO: 3412 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDSGGEPPSMTQLLRR

SEQ ID NO: 3413 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDSGSEPPSMTQLLRR

SEQ ID NO: 3414 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDSGAEPPSMTQLLRR

SEQ ID NO: 3415 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDSSGEPPSMTQLLRR

SEQ ID NO: 3416 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDSSSEPPSMTQLLRR

SEQ ID NO: 3417 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDSSAEPPSMTQLLRR

SEQ ID NO: 3418 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDSAGEPPSMTQLLRR

SEQ ID NO: 3419 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDSASEPPSMTQLLRR

SEQ ID NO: 3420 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDSAAEPPSMTQLLRR

SEQ ID NO: 3421 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDAGGEPPSMTQLLRR

SEQ ID NO: 3422 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDAGSEPPSMTQLLRR

SEQ ID NO: 3423 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDAGAEPPSMTQLLRR

SEQ ID NO: 3424 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDASGEPPSMTQLLRR

SEQ ID NO: 3425 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDASSEPPSMTQLLRR

SEQ ID NO: 3426 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDASAEPPSMTQLLRR

SEQ ID NO: 3427 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDAAGEPPSMTQLLRR

SEQ ID NO: 3428 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDAASEPPSMTQLLRR

SEQ ID NO: 3429 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKHGVSNKDIEKETAKDAAAEPPSMTQLLRR

SEQ ID NO: 3430 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDGGGEPPSMTQLLRR

SEQ ID NO: 3431 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDGGSEPPSMTQLLRR

SEQ ID NO: 3432 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDGGAEPPSMTQLLRR

SEQ ID NO: 3433 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDGSGEPPSMTQLLRR

SEQ ID NO: 3434 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDGSSEPPSMTQLLRR

SEQ ID NO: 3435 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDGSAEPPSMTQLLRR

SEQ ID NO: 3436 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDGAGEPPSMTQLLRR

SEQ ID NO: 3437 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDGASEPPSMTQLLRR

SEQ ID NO: 3438 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDGAAEPPSMTQLLRR

SEQ ID NO: 3439 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDSGGEPPSMTQLLRR

SEQ ID NO: 3440 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDSGSEPPSMTQLLRR

SEQ ID NO: 3441 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDSGAEPPSMTQLLRR

SEQ ID NO: 3442 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDSSGEPPSMTQLLRR

SEQ ID NO: 3443 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDSSSEPPSMTQLLRR

SEQ ID NO: 3444 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDSSAEPPSMTQLLRR

SEQ ID NO: 3445 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDSAGEPPSMTQLLRR

SEQ ID NO: 3446 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDSASEPPSMTQLLRR

SEQ ID NO: 3447 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDSAAEPPSMTQLLRR

SEQ ID NO: 3448 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDAGGEPPSMTQLLRR

SEQ ID NO: 3449 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDAGSEPPSMTQLLRR

SEQ ID NO: 3450 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDAGAEPPSMTQLLRR

SEQ ID NO: 3451 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDASGEPPSMTQLLRR

SEQ ID NO: 3452 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDASSEPPSMTQLLRR

SEQ ID NO: 3453 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDASAEPPSMTQLLRR

SEQ ID NO: 3454 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDAAGEPPSMTQLLRR

SEQ ID NO: 3455 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDAASEPPSMTQLLRR

SEQ ID NO: 3456 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKYGVSNKDIEKETAKDAAAEPPSMTQLLRR

SEQ ID NO: 3457 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDGGGEPPSMTQLLRR

SEQ ID NO: 3458 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDGGSEPPSMTQLLRR

SEQ ID NO: 3459 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDGGAEPPSMTQLLRR

SEQ ID NO: 3460 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDGSGEPPSMTQLLRR

SEQ ID NO: 3461 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDGSSEPPSMTQLLRR

SEQ ID NO: 3462 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDGSAEPPSMTQLLRR

SEQ ID NO: 3463 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDGAGEPPSMTQLLRR

SEQ ID NO: 3464 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDGASEPPSMTQLLRR

SEQ ID NO: 3465 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDGAAEPPSMTQLLRR

SEQ ID NO: 3466 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDSGGEPPSMTQLLRR

SEQ ID NO: 3467 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDSGSEPPSMTQLLRR

SEQ ID NO: 3468 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDSGAEPPSMTQLLRR

SEQ ID NO: 3469 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDSSGEPPSMTQLLRR

SEQ ID NO: 3470 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDSSSEPPSMTQLLRR

SEQ ID NO: 3471 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDSSAEPPSMTQLLRR

SEQ ID NO: 3472 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDSAGEPPSMTQLLRR

SEQ ID NO: 3473 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDSASEPPSMTQLLRR

SEQ ID NO: 3474 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDSAAEPPSMTQLLRR

SEQ ID NO: 3475 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDAGGEPPSMTQLLRR

SEQ ID NO: 3476 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDAGSEPPSMTQLLRR

SEQ ID NO: 3477 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDAGAEPPSMTQLLRR

SEQ ID NO: 3478 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDASGEPPSMTQLLRR

SEQ ID NO: 3479 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDASSEPPSMTQLLRR

SEQ ID NO: 3480 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDASAEPPSMTQLLRR

SEQ ID NO: 3481 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDAAGEPPSMTQLLRR

SEQ ID NO: 3482 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDAASEPPSMTQLLRR

SEQ ID NO: 3483 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKKGVSNKDIEKETAKDAAAEPPSMTQLLRR

SEQ ID NO: 3484 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDGGGEPPSMTQLLRR

SEQ ID NO: 3485 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDGGSEPPSMTQLLRR

SEQ ID NO: 3486 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDGGAEPPSMTQLLRR

SEQ ID NO: 3487 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDGSGEPPSMTQLLRR

SEQ ID NO: 3488 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDGSSEPPSMTQLLRR

SEQ ID NO: 3489 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDGSAEPPSMTQLLRR

SEQ ID NO: 3490 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDGAGEPPSMTQLLRR

SEQ ID NO: 3491 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDGASEPPSMTQLLRR

SEQ ID NO: 3492 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDGAAEPPSMTQLLRR

SEQ ID NO: 3493 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDSGGEPPSMTQLLRR

SEQ ID NO: 3494 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDSGSEPPSMTQLLRR

SEQ ID NO: 3495 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDSGAEPPSMTQLLRR

SEQ ID NO: 3496 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDSSGEPPSMTQLLRR

SEQ ID NO: 3497 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDSSSEPPSMTQLLRR

SEQ ID NO: 3498 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDSSAEPPSMTQLLRR

SEQ ID NO: 3499 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDSAGEPPSMTQLLRR

SEQ ID NO: 3500 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDSASEPPSMTQLLRR

SEQ ID NO: 3501 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDSAAEPPSMTQLLRR

SEQ ID NO: 3502 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDAGGEPPSMTQLLRR

SEQ ID NO: 3503 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDAGSEPPSMTQLLRR

SEQ ID NO: 3504 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDAGAEPPSMTQLLRR

SEQ ID NO: 3505 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDASGEPPSMTQLLRR

SEQ ID NO: 3506 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDASSEPPSMTQLLRR

SEQ ID NO: 3507 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDASAEPPSMTQLLRR

SEQ ID NO: 3508 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDAAGEPPSMTQLLRR

SEQ ID NO: 3509 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDAASEPPSMTQLLRR

SEQ ID NO: 3510 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKNGVSNKDIEKETAKDAAAEPPSMTQLLRR

SEQ ID NO: 3511 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDGGGEPPSMTQLLRR

SEQ ID NO: 3512 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDGGSEPPSMTQLLRR

SEQ ID NO: 3513 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDGGAEPPSMTQLLRR

SEQ ID NO: 3514 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDGSGEPPSMTQLLRR

SEQ ID NO: 3515 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDGSSEPPSMTQLLRR

SEQ ID NO: 3516 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDGSAEPPSMTQLLRR

SEQ ID NO: 3517 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDGAGEPPSMTQLLRR

SEQ ID NO: 3518 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDGASEPPSMTQLLRR

SEQ ID NO: 3519 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDGAAEPPSMTQLLRR

SEQ ID NO: 3520 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDSGGEPPSMTQLLRR

SEQ ID NO: 3521 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDSGSEPPSMTQLLRR

SEQ ID NO: 3522 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDSGAEPPSMTQLLRR

SEQ ID NO: 3523 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDSSGEPPSMTQLLRR

SEQ ID NO: 3524 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDSSSEPPSMTQLLRR

SEQ ID NO: 3525 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDSSAEPPSMTQLLRR

SEQ ID NO: 3526 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDSAGEPPSMTQLLRR

SEQ ID NO: 3527 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDSASEPPSMTQLLRR

SEQ ID NO: 3528 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDSAAEPPSMTQLLRR

SEQ ID NO: 3529 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDAGGEPPSMTQLLRR

SEQ ID NO: 3530 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDAGSEPPSMTQLLRR

SEQ ID NO: 3531 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDAGAEPPSMTQLLRR

SEQ ID NO: 3532 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDASGEPPSMTQLLRR

SEQ ID NO: 3533 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDASSEPPSMTQLLRR

SEQ ID NO: 3534 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDASAEPPSMTQLLRR

SEQ ID NO: 3535 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDAAGEPPSMTQLLRR

SEQ ID NO: 3536 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDAASEPPSMTQLLRR

SEQ ID NO: 3537 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDAFGLRGLLHLENASYGIEPLQNSSHFEHIIYRMDDVYKEPLKMGVSNKDIEKETAKDAAAEPPSMTQLLRR

SEQ ID NO: 3538 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDGGGEPPSMTQLLRR

SEQ ID NO: 3539 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDGGSEPPSMTQLLRR

SEQ ID NO: 3540 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDGGAEPPSMTQLLRR

SEQ ID NO: 3541 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDGSGEPPSMTQLLRR

SEQ ID NO: 3542 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDGSSEPPSMTQLLRR

SEQ ID NO: 3543 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDGSAEPPSMTQLLRR

SEQ ID NO: 3544 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDGAGEPPSMTQLLRR

SEQ ID NO: 3545 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDGASEPPSMTQLLRR

SEQ ID NO: 3546 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDGAAEPPSMTQLLRR

SEQ ID NO: 3547 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDSGGEPPSMTQLLRR

SEQ ID NO: 3548 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDSGSEPPSMTQLLRR

SEQ ID NO: 3549 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDSGAEPPSMTQLLRR

SEQ ID NO: 3550 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDSSGEPPSMTQLLRR

SEQ ID NO: 3551 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDSSSEPPSMTQLLRR

SEQ ID NO: 3552 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDSSAEPPSMTQLLRR

SEQ ID NO: 3553 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDSAGEPPSMTQLLRR

SEQ ID NO: 3554 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDSASEPPSMTQLLRR

SEQ ID NO: 3555 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDSAAEPPSMTQLLRR

SEQ ID NO: 3556 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDAGGEPPSMTQLLRR

SEQ ID NO: 3557 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDAGSEPPSMTQLLRR

SEQ ID NO: 3558 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDAGAEPPSMTQLLRR

SEQ ID NO: 3559 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDASGEPPSMTQLLRR

SEQ ID NO: 3560 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDASSEPPSMTQLLRR

SEQ ID NO: 3561 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDASAEPPSMTQLLRR

SEQ ID NO: 3562 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDAAGEPPSMTQLLRR

SEQ ID NO: 3563 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDAASEPPSMTQLLRR

SEQ ID NO: 3564 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKCGVSNKDIEKETAKDAAAEPPSMTQLLRR

SEQ ID NO: 3565 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDGGGEPPSMTQLLRR

SEQ ID NO: 3566 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDGGSEPPSMTQLLRR

SEQ ID NO: 3567 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDGGAEPPSMTQLLRR

SEQ ID NO: 3568 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDGSGEPPSMTQLLRR

SEQ ID NO: 3569 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDGSSEPPSMTQLLRR

SEQ ID NO: 3570 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDGSAEPPSMTQLLRR

SEQ ID NO: 3571 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDGAGEPPSMTQLLRR

SEQ ID NO: 3572 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDGASEPPSMTQLLRR

SEQ ID NO: 3573 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDGAAEPPSMTQLLRR

SEQ ID NO: 3574 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDSGGEPPSMTQLLRR

SEQ ID NO: 3575 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDSGSEPPSMTQLLRR

SEQ ID NO: 3576 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDSGAEPPSMTQLLRR

SEQ ID NO: 3577 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDSSGEPPSMTQLLRR

SEQ ID NO: 3578 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDSSSEPPSMTQLLRR

SEQ ID NO: 3579 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDSSAEPPSMTQLLRR

SEQ ID NO: 3580 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDSAGEPPSMTQLLRR

SEQ ID NO: 3581 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDSASEPPSMTQLLRR

SEQ ID NO: 3582 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDSAAEPPSMTQLLRR

SEQ ID NO: 3583 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDAGGEPPSMTQLLRR

SEQ ID NO: 3584 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDAGSEPPSMTQLLRR

SEQ ID NO: 3585 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDAGAEPPSMTQLLRR

SEQ ID NO: 3586 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDASGEPPSMTQLLRR

SEQ ID NO: 3587 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDASSEPPSMTQLLRR

SEQ ID NO: 3588 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDASAEPPSMTQLLRR

SEQ ID NO: 3589 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDAAGEPPSMTQLLRR

SEQ ID NO: 3590 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDAASEPPSMTQLLRR

SEQ ID NO: 3591 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKSGVSNKDIEKETAKDAAAEPPSMTQLLRR

SEQ ID NO: 3592 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDGGGEPPSMTQLLRR

SEQ ID NO: 3593 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDGGSEPPSMTQLLRR

SEQ ID NO: 3594 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDGGAEPPSMTQLLRR

SEQ ID NO: 3595 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDGSGEPPSMTQLLRR

SEQ ID NO: 3596 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDGSSEPPSMTQLLRR

SEQ ID NO: 3597 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDGSAEPPSMTQLLRR

SEQ ID NO: 3598 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDGAGEPPSMTQLLRR

SEQ ID NO: 3599 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDGASEPPSMTQLLRR

SEQ ID NO: 3600 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDGAAEPPSMTQLLRR

SEQ ID NO: 3601 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDSGGEPPSMTQLLRR

SEQ ID NO: 3602 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDSGSEPPSMTQLLRR

SEQ ID NO: 3603 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDSGAEPPSMTQLLRR

SEQ ID NO: 3604 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDSSGEPPSMTQLLRR

SEQ ID NO: 3605 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDSSSEPPSMTQLLRR

SEQ ID NO: 3606 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDSSAEPPSMTQLLRR

SEQ ID NO: 3607 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDSAGEPPSMTQLLRR

SEQ ID NO: 3608 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDSASEPPSMTQLLRR

SEQ ID NO: 3609 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDSAAEPPSMTQLLRR

SEQ ID NO: 3610 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDAGGEPPSMTQLLRR

SEQ ID NO: 3611 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDAGSEPPSMTQLLRR

SEQ ID NO: 3612 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDAGAEPPSMTQLLRR

SEQ ID NO: 3613 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDASGEPPSMTQLLRR

SEQ ID NO: 3614 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDASSEPPSMTQLLRR

SEQ ID NO: 3615 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDASAEPPSMTQLLRR

SEQ ID NO: 3616 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDAAGEPPSMTQLLRR

SEQ ID NO: 3617 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDAASEPPSMTQLLRR

SEQ ID NO: 3618 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKAGVSNKDIEKETAKDAAAEPPSMTQLLRR

SEQ ID NO: 3619 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDGGGEPPSMTQLLRR

SEQ ID NO: 3620 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDGGSEPPSMTQLLRR

SEQ ID NO: 3621 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDGGAEPPSMTQLLRR

SEQ ID NO: 3622 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDGSGEPPSMTQLLRR

SEQ ID NO: 3623 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDGSSEPPSMTQLLRR

SEQ ID NO: 3624 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDGSAEPPSMTQLLRR

SEQ ID NO: 3625 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDGAGEPPSMTQLLRR

SEQ ID NO: 3626 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDGASEPPSMTQLLRR

SEQ ID NO: 3627 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDGAAEPPSMTQLLRR

SEQ ID NO: 3628 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDSGGEPPSMTQLLRR

SEQ ID NO: 3629 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDSGSEPPSMTQLLRR

SEQ ID NO: 3630 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDSGAEPPSMTQLLRR

SEQ ID NO: 3631 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDSSGEPPSMTQLLRR

SEQ ID NO: 3632 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDSSSEPPSMTQLLRR

SEQ ID NO: 3633 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDSSAEPPSMTQLLRR

SEQ ID NO: 3634 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDSAGEPPSMTQLLRR

SEQ ID NO: 3635 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDSASEPPSMTQLLRR

SEQ ID NO: 3636 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDSAAEPPSMTQLLRR

SEQ ID NO: 3637 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDAGGEPPSMTQLLRR

SEQ ID NO: 3638 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDAGSEPPSMTQLLRR

SEQ ID NO: 3639 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDAGAEPPSMTQLLRR

SEQ ID NO: 3640 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDASGEPPSMTQLLRR

SEQ ID NO: 3641 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDASSEPPSMTQLLRR

SEQ ID NO: 3642 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDASAEPPSMTQLLRR

SEQ ID NO: 3643 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDAAGEPPSMTQLLRR

SEQ ID NO: 3644 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDAASEPPSMTQLLRR

SEQ ID NO: 3645 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKGGVSNKDIEKETAKDAAAEPPSMTQLLRR

SEQ ID NO: 3646 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDGGGEPPSMTQLLRR

SEQ ID NO: 3647 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDGGSEPPSMTQLLRR

SEQ ID NO: 3648 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDGGAEPPSMTQLLRR

SEQ ID NO: 3649 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDGSGEPPSMTQLLRR

SEQ ID NO: 3650 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDGSSEPPSMTQLLRR

SEQ ID NO: 3651 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDGSAEPPSMTQLLRR

SEQ ID NO: 3652 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDGAGEPPSMTQLLRR

SEQ ID NO: 3653 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDGASEPPSMTQLLRR

SEQ ID NO: 3654 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDGAAEPPSMTQLLRR

SEQ ID NO: 3655 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDSGGEPPSMTQLLRR

SEQ ID NO: 3656 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDSGSEPPSMTQLLRR

SEQ ID NO: 3657 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDSGAEPPSMTQLLRR

SEQ ID NO: 3658 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDSSGEPPSMTQLLRR

SEQ ID NO: 3659 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDSSSEPPSMTQLLRR

SEQ ID NO: 3660 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDSSAEPPSMTQLLRR

SEQ ID NO: 3661 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDSAGEPPSMTQLLRR

SEQ ID NO: 3662 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDSASEPPSMTQLLRR

SEQ ID NO: 3663 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDSAAEPPSMTQLLRR

SEQ ID NO: 3664 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDAGGEPPSMTQLLRR

SEQ ID NO: 3665 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDAGSEPPSMTQLLRR

SEQ ID NO: 3666 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDAGAEPPSMTQLLRR

SEQ ID NO: 3667 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDASGEPPSMTQLLRR

SEQ ID NO: 3668 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDASSEPPSMTQLLRR

SEQ ID NO: 3669 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDASAEPPSMTQLLRR

SEQ ID NO: 3670 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDAAGEPPSMTQLLRR

SEQ ID NO: 3671 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDAASEPPSMTQLLRR

SEQ ID NO: 3672 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKDGVSNKDIEKETAKDAAAEPPSMTQLLRR

SEQ ID NO: 3673 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDGGGEPPSMTQLLRR

SEQ ID NO: 3674 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDGGSEPPSMTQLLRR

SEQ ID NO: 3675 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDGGAEPPSMTQLLRR

SEQ ID NO: 3676 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDGSGEPPSMTQLLRR

SEQ ID NO: 3677 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDGSSEPPSMTQLLRR

SEQ ID NO: 3678 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDGSAEPPSMTQLLRR

SEQ ID NO: 3679 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDGAGEPPSMTQLLRR

SEQ ID NO: 3680 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDGASEPPSMTQLLRR

SEQ ID NO: 3681 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDGAAEPPSMTQLLRR

SEQ ID NO: 3682 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDSGGEPPSMTQLLRR

SEQ ID NO: 3683 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDSGSEPPSMTQLLRR

SEQ ID NO: 3684 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDSGAEPPSMTQLLRR

SEQ ID NO: 3685 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDSSGEPPSMTQLLRR

SEQ ID NO: 3686 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDSSSEPPSMTQLLRR

SEQ ID NO: 3687 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDSSAEPPSMTQLLRR

SEQ ID NO: 3688 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDSAGEPPSMTQLLRR

SEQ ID NO: 3689 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDSASEPPSMTQLLRR

SEQ ID NO: 3690 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDSAAEPPSMTQLLRR

SEQ ID NO: 3691 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDAGGEPPSMTQLLRR

SEQ ID NO: 3692 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDAGSEPPSMTQLLRR

SEQ ID NO: 3693 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDAGAEPPSMTQLLRR

SEQ ID NO: 3694 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDASGEPPSMTQLLRR

SEQ ID NO: 3695 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDASSEPPSMTQLLRR

SEQ ID NO: 3696 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDASAEPPSMTQLLRR

SEQ ID NO: 3697 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDAAGEPPSMTQLLRR

SEQ ID NO: 3698 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDAASEPPSMTQLLRR

SEQ ID NO: 3699 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKHGVSNKDIEKETAKDAAAEPPSMTQLLRR

SEQ ID NO: 3700 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDGGGEPPSMTQLLRR

SEQ ID NO: 3701 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDGGSEPPSMTQLLRR

SEQ ID NO: 3702 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDGGAEPPSMTQLLRR

SEQ ID NO: 3703 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDGSGEPPSMTQLLRR

SEQ ID NO: 3704 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDGSSEPPSMTQLLRR

SEQ ID NO: 3705 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDGSAEPPSMTQLLRR

SEQ ID NO: 3706 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDGAGEPPSMTQLLRR

SEQ ID NO: 3707 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDGASEPPSMTQLLRR

SEQ ID NO: 3708 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDGAAEPPSMTQLLRR

SEQ ID NO: 3709 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDSGGEPPSMTQLLRR

SEQ ID NO: 3710 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDSGSEPPSMTQLLRR

SEQ ID NO: 3711 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDSGAEPPSMTQLLRR

SEQ ID NO: 3712 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDSSGEPPSMTQLLRR

SEQ ID NO: 3713 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDSSSEPPSMTQLLRR

SEQ ID NO: 3714 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDSSAEPPSMTQLLRR

SEQ ID NO: 3715 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDSAGEPPSMTQLLRR

SEQ ID NO: 3716 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDSASEPPSMTQLLRR

SEQ ID NO: 3717 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDSAAEPPSMTQLLRR

SEQ ID NO: 3718 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDAGGEPPSMTQLLRR

SEQ ID NO: 3719 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDAGSEPPSMTQLLRR

SEQ ID NO: 3720 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDAGAEPPSMTQLLRR

SEQ ID NO: 3721 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDASGEPPSMTQLLRR

SEQ ID NO: 3722 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDASSEPPSMTQLLRR

SEQ ID NO: 3723 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDASAEPPSMTQLLRR

SEQ ID NO: 3724 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDAAGEPPSMTQLLRR

SEQ ID NO: 3725 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDAASEPPSMTQLLRR

SEQ ID NO: 3726 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKYGVSNKDIEKETAKDAAAEPPSMTQLLRR

SEQ ID NO: 3727 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDGGGEPPSMTQLLRR

SEQ ID NO: 3728 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDGGSEPPSMTQLLRR

SEQ ID NO: 3729 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDGGAEPPSMTQLLRR

SEQ ID NO: 3730 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDGSGEPPSMTQLLRR

SEQ ID NO: 3731 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDGSSEPPSMTQLLRR

SEQ ID NO: 3732 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDGSAEPPSMTQLLRR

SEQ ID NO: 3733 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDGAGEPPSMTQLLRR

SEQ ID NO: 3734 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDGASEPPSMTQLLRR

SEQ ID NO: 3735 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDGAAEPPSMTQLLRR

SEQ ID NO: 3736 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDSGGEPPSMTQLLRR

SEQ ID NO: 3737 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDSGSEPPSMTQLLRR

SEQ ID NO: 3738 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDSGAEPPSMTQLLRR

SEQ ID NO: 3739 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDSSGEPPSMTQLLRR

SEQ ID NO: 3740 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDSSSEPPSMTQLLRR

SEQ ID NO: 3741 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDSSAEPPSMTQLLRR

SEQ ID NO: 3742 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDSAGEPPSMTQLLRR

SEQ ID NO: 3743 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDSASEPPSMTQLLRR

SEQ ID NO: 3744 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDSAAEPPSMTQLLRR

SEQ ID NO: 3745 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDAGGEPPSMTQLLRR

SEQ ID NO: 3746 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDAGSEPPSMTQLLRR

SEQ ID NO: 3747 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDAGAEPPSMTQLLRR

SEQ ID NO: 3748 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDASGEPPSMTQLLRR

SEQ ID NO: 3749 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDASSEPPSMTQLLRR

SEQ ID NO: 3750 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDASAEPPSMTQLLRR

SEQ ID NO: 3751 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDAAGEPPSMTQLLRR

SEQ ID NO: 3752 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDAASEPPSMTQLLRR

SEQ ID NO: 3753 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKKGVSNKDIEKETAKDAAAEPPSMTQLLRR

SEQ ID NO: 3754 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDGGGEPPSMTQLLRR

SEQ ID NO: 3755 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDGGSEPPSMTQLLRR

SEQ ID NO: 3756 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDGGAEPPSMTQLLRR

SEQ ID NO: 3757 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDGSGEPPSMTQLLRR

SEQ ID NO: 3758 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDGSSEPPSMTQLLRR

SEQ ID NO: 3759 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDGSAEPPSMTQLLRR

SEQ ID NO: 3760 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDGAGEPPSMTQLLRR

SEQ ID NO: 3761 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDGASEPPSMTQLLRR

SEQ ID NO: 3762 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDGAAEPPSMTQLLRR

SEQ ID NO: 3763 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDSGGEPPSMTQLLRR

SEQ ID NO: 3764 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDSGSEPPSMTQLLRR

SEQ ID NO: 3765 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDSGAEPPSMTQLLRR

SEQ ID NO: 3766 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDSSGEPPSMTQLLRR

SEQ ID NO: 3767 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDSSSEPPSMTQLLRR

SEQ ID NO: 3768 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDSSAEPPSMTQLLRR

SEQ ID NO: 3769 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDSAGEPPSMTQLLRR

SEQ ID NO: 3770 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDSASEPPSMTQLLRR

SEQ ID NO: 3771 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDSAAEPPSMTQLLRR

SEQ ID NO: 3772 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDAGGEPPSMTQLLRR

SEQ ID NO: 3773 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDAGSEPPSMTQLLRR

SEQ ID NO: 3774 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDAGAEPPSMTQLLRR

SEQ ID NO: 3775 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDASGEPPSMTQLLRR

SEQ ID NO: 3776 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDASSEPPSMTQLLRR

SEQ ID NO: 3777 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDASAEPPSMTQLLRR

SEQ ID NO: 3778 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDAAGEPPSMTQLLRR

SEQ ID NO: 3779 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDAASEPPSMTQLLRR

SEQ ID NO: 3780 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKNGVSNKDIEKETAKDAAAEPPSMTQLLRR

SEQ ID NO: 3781 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDGGGEPPSMTQLLRR

SEQ ID NO: 3782 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDGGSEPPSMTQLLRR

SEQ ID NO: 3783 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDGGAEPPSMTQLLRR

SEQ ID NO: 3784 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDGSGEPPSMTQLLRR

SEQ ID NO: 3785 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDGSSEPPSMTQLLRR

SEQ ID NO: 3786 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDGSAEPPSMTQLLRR

SEQ ID NO: 3787 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDGAGEPPSMTQLLRR

SEQ ID NO: 3788 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDGASEPPSMTQLLRR

SEQ ID NO: 3789 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDGAAEPPSMTQLLRR

SEQ ID NO: 3790 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDSGGEPPSMTQLLRR

SEQ ID NO: 3791 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDSGSEPPSMTQLLRR

SEQ ID NO: 3792 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDSGAEPPSMTQLLRR

SEQ ID NO: 3793 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDSSGEPPSMTQLLRR

SEQ ID NO: 3794 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDSSSEPPSMTQLLRR

SEQ ID NO: 3795 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDSSAEPPSMTQLLRR

SEQ ID NO: 3796 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDSAGEPPSMTQLLRR

SEQ ID NO: 3797 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDSASEPPSMTQLLRR

SEQ ID NO: 3798 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDSAAEPPSMTQLLRR

SEQ ID NO: 3799 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDAGGEPPSMTQLLRR

SEQ ID NO: 3800 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDAGSEPPSMTQLLRR

SEQ ID NO: 3801 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDAGAEPPSMTQLLRR

SEQ ID NO: 3802 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDASGEPPSMTQLLRR

SEQ ID NO: 3803 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDASSEPPSMTQLLRR

SEQ ID NO: 3804 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDASAEPPSMTQLLRR

SEQ ID NO: 3805 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDAAGEPPSMTQLLRR

SEQ ID NO: 3806 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDAASEPPSMTQLLRR

SEQ ID NO: 3807 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDGFGLRGLLHLENASYGIEPLQNSSHFEHIIYRMDDVYKEPLKMGVSNKDIEKETAKDAAAEPPSMTQLLRR

SEQ ID NO: 3808 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDGGGEPPSMTQLLRR

SEQ ID NO: 3809 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDGGSEPPSMTQLLRR

SEQ ID NO: 3810 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDGGAEPPSMTQLLRR

SEQ ID NO: 3811 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDGSGEPPSMTQLLRR

SEQ ID NO: 3812 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDGSSEPPSMTQLLRR

SEQ ID NO: 3813 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDGSAEPPSMTQLLRR

SEQ ID NO: 3814 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDGAGEPPSMTQLLRR

SEQ ID NO: 3815 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDGASEPPSMTQLLRR

SEQ ID NO: 3816 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDGAAEPPSMTQLLRR

SEQ ID NO: 3817 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDSGGEPPSMTQLLRR

SEQ ID NO: 3818 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDSGSEPPSMTQLLRR

SEQ ID NO: 3819 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDSGAEPPSMTQLLRR

SEQ ID NO: 3820 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDSSGEPPSMTQLLRR

SEQ ID NO: 3821 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDSSSEPPSMTQLLRR

SEQ ID NO: 3822 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDSSAEPPSMTQLLRR

SEQ ID NO: 3823 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDSAGEPPSMTQLLRR

SEQ ID NO: 3824 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDSASEPPSMTQLLRR

SEQ ID NO: 3825 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDSAAEPPSMTQLLRR

SEQ ID NO: 3826 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDAGGEPPSMTQLLRR

SEQ ID NO: 3827 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDAGSEPPSMTQLLRR

SEQ ID NO: 3828 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDAGAEPPSMTQLLRR

SEQ ID NO: 3829 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDASGEPPSMTQLLRR

SEQ ID NO: 3830 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDASSEPPSMTQLLRR

SEQ ID NO: 3831 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDASAEPPSMTQLLRR

SEQ ID NO: 3832 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDAAGEPPSMTQLLRR

SEQ ID NO: 3833 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDAASEPPSMTQLLRR

SEQ ID NO: 3834 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKCGVSNKDIEKETAKDAAAEPPSMTQLLRR

SEQ ID NO: 3835 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDGGGEPPSMTQLLRR

SEQ ID NO: 3836 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDGGSEPPSMTQLLRR

SEQ ID NO: 3837 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDGGAEPPSMTQLLRR

SEQ ID NO: 3838 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDGSGEPPSMTQLLRR

SEQ ID NO: 3839 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDGSSEPPSMTQLLRR

SEQ ID NO: 3840 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDGSAEPPSMTQLLRR

SEQ ID NO: 3841 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDGAGEPPSMTQLLRR

SEQ ID NO: 3842 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDGASEPPSMTQLLRR

SEQ ID NO: 3843 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDGAAEPPSMTQLLRR

SEQ ID NO: 3844 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDSGGEPPSMTQLLRR

SEQ ID NO: 3845 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDSGSEPPSMTQLLRR

SEQ ID NO: 3846 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDSGAEPPSMTQLLRR

SEQ ID NO: 3847 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDSSGEPPSMTQLLRR

SEQ ID NO: 3848 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDSSSEPPSMTQLLRR

SEQ ID NO: 3849 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDSSAEPPSMTQLLRR

SEQ ID NO: 3850 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDSAGEPPSMTQLLRR

SEQ ID NO: 3851 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDSASEPPSMTQLLRR

SEQ ID NO: 3852 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDSAAEPPSMTQLLRR

SEQ ID NO: 3853 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDAGGEPPSMTQLLRR

SEQ ID NO: 3854 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDAGSEPPSMTQLLRR

SEQ ID NO: 3855 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDAGAEPPSMTQLLRR

SEQ ID NO: 3856 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDASGEPPSMTQLLRR

SEQ ID NO: 3857 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDASSEPPSMTQLLRR

SEQ ID NO: 3858 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDASAEPPSMTQLLRR

SEQ ID NO: 3859 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDAAGEPPSMTQLLRR

SEQ ID NO: 3860 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDAASEPPSMTQLLRR

SEQ ID NO: 3861 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKSGVSNKDIEKETAKDAAAEPPSMTQLLRR

SEQ ID NO: 3862 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDGGGEPPSMTQLLRR

SEQ ID NO: 3863 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDGGSEPPSMTQLLRR

SEQ ID NO: 3864 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDGGAEPPSMTQLLRR

SEQ ID NO: 3865 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDGSGEPPSMTQLLRR

SEQ ID NO: 3866 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDGSSEPPSMTQLLRR

SEQ ID NO: 3867 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDGSAEPPSMTQLLRR

SEQ ID NO: 3868 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDGAGEPPSMTQLLRR

SEQ ID NO: 3869 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDGASEPPSMTQLLRR

SEQ ID NO: 3870 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDGAAEPPSMTQLLRR

SEQ ID NO: 3871 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDSGGEPPSMTQLLRR

SEQ ID NO: 3872 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDSGSEPPSMTQLLRR

SEQ ID NO: 3873 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDSGAEPPSMTQLLRR

SEQ ID NO: 3874 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDSSGEPPSMTQLLRR

SEQ ID NO: 3875 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDSSSEPPSMTQLLRR

SEQ ID NO: 3876 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDSSAEPPSMTQLLRR

SEQ ID NO: 3877 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDSAGEPPSMTQLLRR

SEQ ID NO: 3878 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDSASEPPSMTQLLRR

SEQ ID NO: 3879 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDSAAEPPSMTQLLRR

SEQ ID NO: 3880 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDAGGEPPSMTQLLRR

SEQ ID NO: 3881 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDAGSEPPSMTQLLRR

SEQ ID NO: 3882 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDAGAEPPSMTQLLRR

SEQ ID NO: 3883 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDASGEPPSMTQLLRR

SEQ ID NO: 3884 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDASSEPPSMTQLLRR

SEQ ID NO: 3885 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDASAEPPSMTQLLRR

SEQ ID NO: 3886 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDAAGEPPSMTQLLRR

SEQ ID NO: 3887 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDAASEPPSMTQLLRR

SEQ ID NO: 3888 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKAGVSNKDIEKETAKDAAAEPPSMTQLLRR

SEQ ID NO: 3889 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDGGGEPPSMTQLLRR

SEQ ID NO: 3890 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDGGSEPPSMTQLLRR

SEQ ID NO: 3891 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDGGAEPPSMTQLLRR

SEQ ID NO: 3892 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDGSGEPPSMTQLLRR

SEQ ID NO: 3893 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDGSSEPPSMTQLLRR

SEQ ID NO: 3894 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDGSAEPPSMTQLLRR

SEQ ID NO: 3895 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDGAGEPPSMTQLLRR

SEQ ID NO: 3896 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDGASEPPSMTQLLRR

SEQ ID NO: 3897 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDGAAEPPSMTQLLRR

SEQ ID NO: 3898 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDSGGEPPSMTQLLRR

SEQ ID NO: 3899 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDSGSEPPSMTQLLRR

SEQ ID NO: 3900 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDSGAEPPSMTQLLRR

SEQ ID NO: 3901 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDSSGEPPSMTQLLRR

SEQ ID NO: 3902 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDSSSEPPSMTQLLRR

SEQ ID NO: 3903 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDSSAEPPSMTQLLRR

SEQ ID NO: 3904 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDSAGEPPSMTQLLRR

SEQ ID NO: 3905 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDSASEPPSMTQLLRR

SEQ ID NO: 3906 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDSAAEPPSMTQLLRR

SEQ ID NO: 3907 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDAGGEPPSMTQLLRR

SEQ ID NO: 3908 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDAGSEPPSMTQLLRR

SEQ ID NO: 3909 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDAGAEPPSMTQLLRR

SEQ ID NO: 3910 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDASGEPPSMTQLLRR

SEQ ID NO: 3911 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDASSEPPSMTQLLRR

SEQ ID NO: 3912 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDASAEPPSMTQLLRR

SEQ ID NO: 3913 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDAAGEPPSMTQLLRR

SEQ ID NO: 3914 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDAASEPPSMTQLLRR

SEQ ID NO: 3915 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKGGVSNKDIEKETAKDAAAEPPSMTQLLRR

SEQ ID NO: 3916 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDGGGEPPSMTQLLRR

SEQ ID NO: 3917 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDGGSEPPSMTQLLRR

SEQ ID NO: 3918 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDGGAEPPSMTQLLRR

SEQ ID NO: 3919 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDGSGEPPSMTQLLRR

SEQ ID NO: 3920 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDGSSEPPSMTQLLRR

SEQ ID NO: 3921 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDGSAEPPSMTQLLRR

SEQ ID NO: 3922 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDGAGEPPSMTQLLRR

SEQ ID NO: 3923 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDGASEPPSMTQLLRR

SEQ ID NO: 3924 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDGAAEPPSMTQLLRR

SEQ ID NO: 3925 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDSGGEPPSMTQLLRR

SEQ ID NO: 3926 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDSGSEPPSMTQLLRR

SEQ ID NO: 3927 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDSGAEPPSMTQLLRR

SEQ ID NO: 3928 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDSSGEPPSMTQLLRR

SEQ ID NO: 3929 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDSSSEPPSMTQLLRR

SEQ ID NO: 3930 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDSSAEPPSMTQLLRR

SEQ ID NO: 3931 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDSAGEPPSMTQLLRR

SEQ ID NO: 3932 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDSASEPPSMTQLLRR

SEQ ID NO: 3933 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDSAAEPPSMTQLLRR

SEQ ID NO: 3934 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDAGGEPPSMTQLLRR

SEQ ID NO: 3935 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDAGSEPPSMTQLLRR

SEQ ID NO: 3936 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDAGAEPPSMTQLLRR

SEQ ID NO: 3937 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDASGEPPSMTQLLRR

SEQ ID NO: 3938 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDASSEPPSMTQLLRR

SEQ ID NO: 3939 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDASAEPPSMTQLLRR

SEQ ID NO: 3940 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDAAGEPPSMTQLLRR

SEQ ID NO: 3941 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDAASEPPSMTQLLRR

SEQ ID NO: 3942 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKDGVSNKDIEKETAKDAAAEPPSMTQLLRR

SEQ ID NO: 3943 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDGGGEPPSMTQLLRR

SEQ ID NO: 3944 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDGGSEPPSMTQLLRR

SEQ ID NO: 3945 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDGGAEPPSMTQLLRR

SEQ ID NO: 3946 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDGSGEPPSMTQLLRR

SEQ ID NO: 3947 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDGSSEPPSMTQLLRR

SEQ ID NO: 3948 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDGSAEPPSMTQLLRR

SEQ ID NO: 3949 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDGAGEPPSMTQLLRR

SEQ ID NO: 3950 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDGASEPPSMTQLLRR

SEQ ID NO: 3951 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDGAAEPPSMTQLLRR

SEQ ID NO: 3952 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDSGGEPPSMTQLLRR

SEQ ID NO: 3953 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDSGSEPPSMTQLLRR

SEQ ID NO: 3954 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDSGAEPPSMTQLLRR

SEQ ID NO: 3955 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDSSGEPPSMTQLLRR

SEQ ID NO: 3956 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDSSSEPPSMTQLLRR

SEQ ID NO: 3957 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDSSAEPPSMTQLLRR

SEQ ID NO: 3958 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDSAGEPPSMTQLLRR

SEQ ID NO: 3959 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDSASEPPSMTQLLRR

SEQ ID NO: 3960 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDSAAEPPSMTQLLRR

SEQ ID NO: 3961 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDAGGEPPSMTQLLRR

SEQ ID NO: 3962 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDAGSEPPSMTQLLRR

SEQ ID NO: 3963 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDAGAEPPSMTQLLRR

SEQ ID NO: 3964 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDASGEPPSMTQLLRR

SEQ ID NO: 3965 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDASSEPPSMTQLLRR

SEQ ID NO: 3966 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDASAEPPSMTQLLRR

SEQ ID NO: 3967 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDAAGEPPSMTQLLRR

SEQ ID NO: 3968 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDAASEPPSMTQLLRR

SEQ ID NO: 3969 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKHGVSNKDIEKETAKDAAAEPPSMTQLLRR

SEQ ID NO: 3970 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDGGGEPPSMTQLLRR

SEQ ID NO: 3971 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDGGSEPPSMTQLLRR

SEQ ID NO: 3972 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDGGAEPPSMTQLLRR

SEQ ID NO: 3973 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDGSGEPPSMTQLLRR

SEQ ID NO: 3974 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDGSSEPPSMTQLLRR

SEQ ID NO: 3975 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDGSAEPPSMTQLLRR

SEQ ID NO: 3976 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDGAGEPPSMTQLLRR

SEQ ID NO: 3977 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDGASEPPSMTQLLRR

SEQ ID NO: 3978 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDGAAEPPSMTQLLRR

SEQ ID NO: 3979 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDSGGEPPSMTQLLRR

SEQ ID NO: 3980 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDSGSEPPSMTQLLRR

SEQ ID NO: 3981 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDSGAEPPSMTQLLRR

SEQ ID NO: 3982 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDSSGEPPSMTQLLRR

SEQ ID NO: 3983 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDSSSEPPSMTQLLRR

SEQ ID NO: 3984 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDSSAEPPSMTQLLRR

SEQ ID NO: 3985 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDSAGEPPSMTQLLRR

SEQ ID NO: 3986 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDSASEPPSMTQLLRR

SEQ ID NO: 3987 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDSAAEPPSMTQLLRR

SEQ ID NO: 3988 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDAGGEPPSMTQLLRR

SEQ ID NO: 3989 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDAGSEPPSMTQLLRR

SEQ ID NO: 3990 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDAGAEPPSMTQLLRR

SEQ ID NO: 3991 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDASGEPPSMTQLLRR

SEQ ID NO: 3992 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDASSEPPSMTQLLRR

SEQ ID NO: 3993 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDASAEPPSMTQLLRR

SEQ ID NO: 3994 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDAAGEPPSMTQLLRR

SEQ ID NO: 3995 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDAASEPPSMTQLLRR

SEQ ID NO: 3996 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKYGVSNKDIEKETAKDAAAEPPSMTQLLRR

SEQ ID NO: 3997 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDGGGEPPSMTQLLRR

SEQ ID NO: 3998 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDGGSEPPSMTQLLRR

SEQ ID NO: 3999 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDGGAEPPSMTQLLRR

SEQ ID NO: 4000 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDGSGEPPSMTQLLRR

SEQ ID NO: 4001 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDGSSEPPSMTQLLRR

SEQ ID NO: 4002 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDGSAEPPSMTQLLRR

SEQ ID NO: 4003 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDGAGEPPSMTQLLRR

SEQ ID NO: 4004 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDGASEPPSMTQLLRR

SEQ ID NO: 4005 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDGAAEPPSMTQLLRR

SEQ ID NO: 4006 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDSGGEPPSMTQLLRR

SEQ ID NO: 4007 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDSGSEPPSMTQLLRR

SEQ ID NO: 4008 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDSGAEPPSMTQLLRR

SEQ ID NO: 4009 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDSSGEPPSMTQLLRR

SEQ ID NO: 4010 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDSSSEPPSMTQLLRR

SEQ ID NO: 4011 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDSSAEPPSMTQLLRR

SEQ ID NO: 4012 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDSAGEPPSMTQLLRR

SEQ ID NO: 4013 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDSASEPPSMTQLLRR

SEQ ID NO: 4014 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDSAAEPPSMTQLLRR

SEQ ID NO: 4015 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDAGGEPPSMTQLLRR

SEQ ID NO: 4016 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDAGSEPPSMTQLLRR

SEQ ID NO: 4017 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDAGAEPPSMTQLLRR

SEQ ID NO: 4018 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDASGEPPSMTQLLRR

SEQ ID NO: 4019 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDASSEPPSMTQLLRR

SEQ ID NO: 4020 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDASAEPPSMTQLLRR

SEQ ID NO: 4021 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDAAGEPPSMTQLLRR

SEQ ID NO: 4022 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDAASEPPSMTQLLRR

SEQ ID NO: 4023 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKKGVSNKDIEKETAKDAAAEPPSMTQLLRR

SEQ ID NO: 4024 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDGGGEPPSMTQLLRR

SEQ ID NO: 4025 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDGGSEPPSMTQLLRR

SEQ ID NO: 4026 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDGGAEPPSMTQLLRR

SEQ ID NO: 4027 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDGSGEPPSMTQLLRR

SEQ ID NO: 4028 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDGSSEPPSMTQLLRR

SEQ ID NO: 4029 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDGSAEPPSMTQLLRR

SEQ ID NO: 4030 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDGAGEPPSMTQLLRR

SEQ ID NO: 4031 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDGASEPPSMTQLLRR

SEQ ID NO: 4032 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDGAAEPPSMTQLLRR

SEQ ID NO: 4033 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDSGGEPPSMTQLLRR

SEQ ID NO: 4034 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDSGSEPPSMTQLLRR

SEQ ID NO: 4035 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDSGAEPPSMTQLLRR

SEQ ID NO: 4036 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDSSGEPPSMTQLLRR

SEQ ID NO: 4037 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDSSSEPPSMTQLLRR

SEQ ID NO: 4038 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDSSAEPPSMTQLLRR

SEQ ID NO: 4039 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDSAGEPPSMTQLLRR

SEQ ID NO: 4040 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDSASEPPSMTQLLRR

SEQ ID NO: 4041 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDSAAEPPSMTQLLRR

SEQ ID NO: 4042 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDAGGEPPSMTQLLRR

SEQ ID NO: 4043 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDAGSEPPSMTQLLRR

SEQ ID NO: 4044 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDAGAEPPSMTQLLRR

SEQ ID NO: 4045 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDASGEPPSMTQLLRR

SEQ ID NO: 4046 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDASSEPPSMTQLLRR

SEQ ID NO: 4047 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDASAEPPSMTQLLRR

SEQ ID NO: 4048 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDAAGEPPSMTQLLRR

SEQ ID NO: 4049 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDAASEPPSMTQLLRR

SEQ ID NO: 4050 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKNGVSNKDIEKETAKDAAAEPPSMTQLLRR

SEQ ID NO: 4051 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDGGGEPPSMTQLLRR

SEQ ID NO: 4052 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDGGSEPPSMTQLLRR

SEQ ID NO: 4053 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDGGAEPPSMTQLLRR

SEQ ID NO: 4054 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDGSGEPPSMTQLLRR

SEQ ID NO: 4055 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDGSSEPPSMTQLLRR

SEQ ID NO: 4056 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDGSAEPPSMTQLLRR

SEQ ID NO: 4057 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDGAGEPPSMTQLLRR

SEQ ID NO: 4058 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDGASEPPSMTQLLRR

SEQ ID NO: 4059 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDGAAEPPSMTQLLRR

SEQ ID NO: 4060 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDSGGEPPSMTQLLRR

SEQ ID NO: 4061 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDSGSEPPSMTQLLRR

SEQ ID NO: 4062 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDSGAEPPSMTQLLRR

SEQ ID NO: 4063 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDSSGEPPSMTQLLRR

SEQ ID NO: 4064 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDSSSEPPSMTQLLRR

SEQ ID NO: 4065 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDSSAEPPSMTQLLRR

SEQ ID NO: 4066 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDSAGEPPSMTQLLRR

SEQ ID NO: 4067 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDSASEPPSMTQLLRR

SEQ ID NO: 4068 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDSAAEPPSMTQLLRR

SEQ ID NO: 4069 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDAGGEPPSMTQLLRR

SEQ ID NO: 4070 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDAGSEPPSMTQLLRR

SEQ ID NO: 4071 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDAGAEPPSMTQLLRR

SEQ ID NO: 4072 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDASGEPPSMTQLLRR

SEQ ID NO: 4073 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDASSEPPSMTQLLRR

SEQ ID NO: 4074 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDASAEPPSMTQLLRR

SEQ ID NO: 4075 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDAAGEPPSMTQLLRR

SEQ ID NO: 4076 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDAASEPPSMTQLLRR

SEQ ID NO: 4077 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDDFGLRGLLHLENASYGIEPLQNSSHFEHIIYRMDDVYKEPLKMGVSNKDIEKETAKDAAAEPPSMTQLLRR

SEQ ID NO: 4078 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDGGGEPPSMTQLLRR

SEQ ID NO: 4079 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDGGSEPPSMTQLLRR

SEQ ID NO: 4080 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDGGAEPPSMTQLLRR

SEQ ID NO: 4081 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDGSGEPPSMTQLLRR

SEQ ID NO: 4082 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDGSSEPPSMTQLLRR

SEQ ID NO: 4083 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDGSAEPPSMTQLLRR

SEQ ID NO: 4084 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDGAGEPPSMTQLLRR

SEQ ID NO: 4085 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDGASEPPSMTQLLRR

SEQ ID NO: 4086 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDGAAEPPSMTQLLRR

SEQ ID NO: 4087 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDSGGEPPSMTQLLRR

SEQ ID NO: 4088 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDSGSEPPSMTQLLRR

SEQ ID NO: 4089 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDSGAEPPSMTQLLRR

SEQ ID NO: 4090 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDSSGEPPSMTQLLRR

SEQ ID NO: 4091 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDSSSEPPSMTQLLRR

SEQ ID NO: 4092 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDSSAEPPSMTQLLRR

SEQ ID NO: 4093 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDSAGEPPSMTQLLRR

SEQ ID NO: 4094 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDSASEPPSMTQLLRR

SEQ ID NO: 4095 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDSAAEPPSMTQLLRR

SEQ ID NO: 4096 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDAGGEPPSMTQLLRR

SEQ ID NO: 4097 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDAGSEPPSMTQLLRR

SEQ ID NO: 4098 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDAGAEPPSMTQLLRR

SEQ ID NO: 4099 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDASGEPPSMTQLLRR

SEQ ID NO: 4100 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDASSEPPSMTQLLRR

SEQ ID NO: 4101 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDASAEPPSMTQLLRR

SEQ ID NO: 4102 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDAAGEPPSMTQLLRR

SEQ ID NO: 4103 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDAASEPPSMTQLLRR

SEQ ID NO: 4104 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKCGVSNKDIEKETAKDAAAEPPSMTQLLRR

SEQ ID NO: 4105 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDGGGEPPSMTQLLRR

SEQ ID NO: 4106 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDGGSEPPSMTQLLRR

SEQ ID NO: 4107 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDGGAEPPSMTQLLRR

SEQ ID NO: 4108 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDGSGEPPSMTQLLRR

SEQ ID NO: 4109 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDGSSEPPSMTQLLRR

SEQ ID NO: 4110 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDGSAEPPSMTQLLRR

SEQ ID NO: 4111 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDGAGEPPSMTQLLRR

SEQ ID NO: 4112 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDGASEPPSMTQLLRR

SEQ ID NO: 4113 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDGAAEPPSMTQLLRR

SEQ ID NO: 4114 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDSGGEPPSMTQLLRR

SEQ ID NO: 4115 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDSGSEPPSMTQLLRR

SEQ ID NO: 4116 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDSGAEPPSMTQLLRR

SEQ ID NO: 4117 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDSSGEPPSMTQLLRR

SEQ ID NO: 4118 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDSSSEPPSMTQLLRR

SEQ ID NO: 4119 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDSSAEPPSMTQLLRR

SEQ ID NO: 4120 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDSAGEPPSMTQLLRR

SEQ ID NO: 4121 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDSASEPPSMTQLLRR

SEQ ID NO: 4122 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDSAAEPPSMTQLLRR

SEQ ID NO: 4123 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDAGGEPPSMTQLLRR

SEQ ID NO: 4124 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDAGSEPPSMTQLLRR

SEQ ID NO: 4125 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDAGAEPPSMTQLLRR

SEQ ID NO: 4126 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDASGEPPSMTQLLRR

SEQ ID NO: 4127 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDASSEPPSMTQLLRR

SEQ ID NO: 4128 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDASAEPPSMTQLLRR

SEQ ID NO: 4129 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDAAGEPPSMTQLLRR

SEQ ID NO: 4130 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDAASEPPSMTQLLRR

SEQ ID NO: 4131 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKSGVSNKDIEKETAKDAAAEPPSMTQLLRR

SEQ ID NO: 4132 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDGGGEPPSMTQLLRR

SEQ ID NO: 4133 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDGGSEPPSMTQLLRR

SEQ ID NO: 4134 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDGGAEPPSMTQLLRR

SEQ ID NO: 4135 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDGSGEPPSMTQLLRR

SEQ ID NO: 4136 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDGSSEPPSMTQLLRR

SEQ ID NO: 4137 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDGSAEPPSMTQLLRR

SEQ ID NO: 4138 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDGAGEPPSMTQLLRR

SEQ ID NO: 4139 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDGASEPPSMTQLLRR

SEQ ID NO: 4140 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDGAAEPPSMTQLLRR

SEQ ID NO: 4141 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDSGGEPPSMTQLLRR

SEQ ID NO: 4142 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDSGSEPPSMTQLLRR

SEQ ID NO: 4143 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDSGAEPPSMTQLLRR

SEQ ID NO: 4144 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDSSGEPPSMTQLLRR

SEQ ID NO: 4145 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDSSSEPPSMTQLLRR

SEQ ID NO: 4146 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDSSAEPPSMTQLLRR

SEQ ID NO: 4147 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDSAGEPPSMTQLLRR

SEQ ID NO: 4148 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDSASEPPSMTQLLRR

SEQ ID NO: 4149 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDSAAEPPSMTQLLRR

SEQ ID NO: 4150 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDAGGEPPSMTQLLRR

SEQ ID NO: 4151 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDAGSEPPSMTQLLRR

SEQ ID NO: 4152 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDAGAEPPSMTQLLRR

SEQ ID NO: 4153 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDASGEPPSMTQLLRR

SEQ ID NO: 4154 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDASSEPPSMTQLLRR

SEQ ID NO: 4155 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDASAEPPSMTQLLRR

SEQ ID NO: 4156 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDAAGEPPSMTQLLRR

SEQ ID NO: 4157 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDAASEPPSMTQLLRR

SEQ ID NO: 4158 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKAGVSNKDIEKETAKDAAAEPPSMTQLLRR

SEQ ID NO: 4159 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDGGGEPPSMTQLLRR

SEQ ID NO: 4160 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDGGSEPPSMTQLLRR

SEQ ID NO: 4161 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDGGAEPPSMTQLLRR

SEQ ID NO: 4162 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDGSGEPPSMTQLLRR

SEQ ID NO: 4163 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDGSSEPPSMTQLLRR

SEQ ID NO: 4164 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDGSAEPPSMTQLLRR

SEQ ID NO: 4165 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDGAGEPPSMTQLLRR

SEQ ID NO: 4166 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDGASEPPSMTQLLRR

SEQ ID NO: 4167 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDGAAEPPSMTQLLRR

SEQ ID NO: 4168 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDSGGEPPSMTQLLRR

SEQ ID NO: 4169 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDSGSEPPSMTQLLRR

SEQ ID NO: 4170 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDSGAEPPSMTQLLRR

SEQ ID NO: 4171 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDSSGEPPSMTQLLRR

SEQ ID NO: 4172 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDSSSEPPSMTQLLRR

SEQ ID NO: 4173 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDSSAEPPSMTQLLRR

SEQ ID NO: 4174 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDSAGEPPSMTQLLRR

SEQ ID NO: 4175 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDSASEPPSMTQLLRR

SEQ ID NO: 4176 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDSAAEPPSMTQLLRR

SEQ ID NO: 4177 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDAGGEPPSMTQLLRR

SEQ ID NO: 4178 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDAGSEPPSMTQLLRR

SEQ ID NO: 4179 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDAGAEPPSMTQLLRR

SEQ ID NO: 4180 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDASGEPPSMTQLLRR

SEQ ID NO: 4181 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDASSEPPSMTQLLRR

SEQ ID NO: 4182 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDASAEPPSMTQLLRR

SEQ ID NO: 4183 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDAAGEPPSMTQLLRR

SEQ ID NO: 4184 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDAASEPPSMTQLLRR

SEQ ID NO: 4185 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKGGVSNKDIEKETAKDAAAEPPSMTQLLRR

SEQ ID NO: 4186 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDGGGEPPSMTQLLRR

SEQ ID NO: 4187 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDGGSEPPSMTQLLRR

SEQ ID NO: 4188 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDGGAEPPSMTQLLRR

SEQ ID NO: 4189 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDGSGEPPSMTQLLRR

SEQ ID NO: 4190 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDGSSEPPSMTQLLRR

SEQ ID NO: 4191 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDGSAEPPSMTQLLRR

SEQ ID NO: 4192 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDGAGEPPSMTQLLRR

SEQ ID NO: 4193 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDGASEPPSMTQLLRR

SEQ ID NO: 4194 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDGAAEPPSMTQLLRR

SEQ ID NO: 4195 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDSGGEPPSMTQLLRR

SEQ ID NO: 4196 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDSGSEPPSMTQLLRR

SEQ ID NO: 4197 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDSGAEPPSMTQLLRR

SEQ ID NO: 4198 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDSSGEPPSMTQLLRR

SEQ ID NO: 4199 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDSSSEPPSMTQLLRR

SEQ ID NO: 4200 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDSSAEPPSMTQLLRR

SEQ ID NO: 4201 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDSAGEPPSMTQLLRR

SEQ ID NO: 4202 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDSASEPPSMTQLLRR

SEQ ID NO: 4203 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDSAAEPPSMTQLLRR

SEQ ID NO: 4204 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDAGGEPPSMTQLLRR

SEQ ID NO: 4205 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDAGSEPPSMTQLLRR

SEQ ID NO: 4206 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDAGAEPPSMTQLLRR

SEQ ID NO: 4207 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDASGEPPSMTQLLRR

SEQ ID NO: 4208 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDASSEPPSMTQLLRR

SEQ ID NO: 4209 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDASAEPPSMTQLLRR

SEQ ID NO: 4210 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDAAGEPPSMTQLLRR

SEQ ID NO: 4211 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDAASEPPSMTQLLRR

SEQ ID NO: 4212 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKDGVSNKDIEKETAKDAAAEPPSMTQLLRR

SEQ ID NO: 4213 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDGGGEPPSMTQLLRR

SEQ ID NO: 4214 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDGGSEPPSMTQLLRR

SEQ ID NO: 4215 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDGGAEPPSMTQLLRR

SEQ ID NO: 4216 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDGSGEPPSMTQLLRR

SEQ ID NO: 4217 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDGSSEPPSMTQLLRR

SEQ ID NO: 4218 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDGSAEPPSMTQLLRR

SEQ ID NO: 4219 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDGAGEPPSMTQLLRR

SEQ ID NO: 4220 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDGASEPPSMTQLLRR

SEQ ID NO: 4221 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDGAAEPPSMTQLLRR

SEQ ID NO: 4222 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDSGGEPPSMTQLLRR

SEQ ID NO: 4223 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDSGSEPPSMTQLLRR

SEQ ID NO: 4224 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDSGAEPPSMTQLLRR

SEQ ID NO: 4225 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDSSGEPPSMTQLLRR

SEQ ID NO: 4226 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDSSSEPPSMTQLLRR

SEQ ID NO: 4227 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDSSAEPPSMTQLLRR

SEQ ID NO: 4228 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDSAGEPPSMTQLLRR

SEQ ID NO: 4229 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDSASEPPSMTQLLRR

SEQ ID NO: 4230 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDSAAEPPSMTQLLRR

SEQ ID NO: 4231 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDAGGEPPSMTQLLRR

SEQ ID NO: 4232 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDAGSEPPSMTQLLRR

SEQ ID NO: 4233 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDAGAEPPSMTQLLRR

SEQ ID NO: 4234 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDASGEPPSMTQLLRR

SEQ ID NO: 4235 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDASSEPPSMTQLLRR

SEQ ID NO: 4236 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDASAEPPSMTQLLRR

SEQ ID NO: 4237 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDAAGEPPSMTQLLRR

SEQ ID NO: 4238 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDAASEPPSMTQLLRR

SEQ ID NO: 4239 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKHGVSNKDIEKETAKDAAAEPPSMTQLLRR

SEQ ID NO: 4240 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDGGGEPPSMTQLLRR

SEQ ID NO: 4241 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDGGSEPPSMTQLLRR

SEQ ID NO: 4242 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDGGAEPPSMTQLLRR

SEQ ID NO: 4243 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDGSGEPPSMTQLLRR

SEQ ID NO: 4244 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDGSSEPPSMTQLLRR

SEQ ID NO: 4245 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDGSAEPPSMTQLLRR

SEQ ID NO: 4246 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDGAGEPPSMTQLLRR

SEQ ID NO: 4247 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDGASEPPSMTQLLRR

SEQ ID NO: 4248 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDGAAEPPSMTQLLRR

SEQ ID NO: 4249 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDSGGEPPSMTQLLRR

SEQ ID NO: 4250 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDSGSEPPSMTQLLRR

SEQ ID NO: 4251 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDSGAEPPSMTQLLRR

SEQ ID NO: 4252 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDSSGEPPSMTQLLRR

SEQ ID NO: 4253 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDSSSEPPSMTQLLRR

SEQ ID NO: 4254 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDSSAEPPSMTQLLRR

SEQ ID NO: 4255 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDSAGEPPSMTQLLRR

SEQ ID NO: 4256 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDSASEPPSMTQLLRR

SEQ ID NO: 4257 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDSAAEPPSMTQLLRR

SEQ ID NO: 4258 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDAGGEPPSMTQLLRR

SEQ ID NO: 4259 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDAGSEPPSMTQLLRR

SEQ ID NO: 4260 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDAGAEPPSMTQLLRR

SEQ ID NO: 4261 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDASGEPPSMTQLLRR

SEQ ID NO: 4262 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDASSEPPSMTQLLRR

SEQ ID NO: 4263 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDASAEPPSMTQLLRR

SEQ ID NO: 4264 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDAAGEPPSMTQLLRR

SEQ ID NO: 4265 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDAASEPPSMTQLLRR

SEQ ID NO: 4266 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKYGVSNKDIEKETAKDAAAEPPSMTQLLRR

SEQ ID NO: 4267 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDGGGEPPSMTQLLRR

SEQ ID NO: 4268 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDGGSEPPSMTQLLRR

SEQ ID NO: 4269 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDGGAEPPSMTQLLRR

SEQ ID NO: 4270 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDGSGEPPSMTQLLRR

SEQ ID NO: 4271 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDGSSEPPSMTQLLRR

SEQ ID NO: 4272 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDGSAEPPSMTQLLRR

SEQ ID NO: 4273 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDGAGEPPSMTQLLRR

SEQ ID NO: 4274 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDGASEPPSMTQLLRR

SEQ ID NO: 4275 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDGAAEPPSMTQLLRR

SEQ ID NO: 4276 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDSGGEPPSMTQLLRR

SEQ ID NO: 4277 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDSGSEPPSMTQLLRR

SEQ ID NO: 4278 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDSGAEPPSMTQLLRR

SEQ ID NO: 4279 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDSSGEPPSMTQLLRR

SEQ ID NO: 4280 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDSSSEPPSMTQLLRR

SEQ ID NO: 4281 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDSSAEPPSMTQLLRR

SEQ ID NO: 4282 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDSAGEPPSMTQLLRR

SEQ ID NO: 4283 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDSASEPPSMTQLLRR

SEQ ID NO: 4284 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDSAAEPPSMTQLLRR

SEQ ID NO: 4285 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDAGGEPPSMTQLLRR

SEQ ID NO: 4286 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDAGSEPPSMTQLLRR

SEQ ID NO: 4287 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDAGAEPPSMTQLLRR

SEQ ID NO: 4288 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDASGEPPSMTQLLRR

SEQ ID NO: 4289 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDASSEPPSMTQLLRR

SEQ ID NO: 4290 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDASAEPPSMTQLLRR

SEQ ID NO: 4291 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDAAGEPPSMTQLLRR

SEQ ID NO: 4292 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDAASEPPSMTQLLRR

SEQ ID NO: 4293 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKKGVSNKDIEKETAKDAAAEPPSMTQLLRR

SEQ ID NO: 4294 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDGGGEPPSMTQLLRR

SEQ ID NO: 4295 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDGGSEPPSMTQLLRR

SEQ ID NO: 4296 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDGGAEPPSMTQLLRR

SEQ ID NO: 4297 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDGSGEPPSMTQLLRR

SEQ ID NO: 4298 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDGSSEPPSMTQLLRR

SEQ ID NO: 4299 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDGSAEPPSMTQLLRR

SEQ ID NO: 4300 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDGAGEPPSMTQLLRR

SEQ ID NO: 4301 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDGASEPPSMTQLLRR

SEQ ID NO: 4302 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDGAAEPPSMTQLLRR

SEQ ID NO: 4303 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDSGGEPPSMTQLLRR

SEQ ID NO: 4304 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDSGSEPPSMTQLLRR

SEQ ID NO: 4305 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDSGAEPPSMTQLLRR

SEQ ID NO: 4306 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDSSGEPPSMTQLLRR

SEQ ID NO: 4307 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDSSSEPPSMTQLLRR

SEQ ID NO: 4308 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDSSAEPPSMTQLLRR

SEQ ID NO: 4309 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDSAGEPPSMTQLLRR

SEQ ID NO: 4310 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDSASEPPSMTQLLRR

SEQ ID NO: 4311 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDSAAEPPSMTQLLRR

SEQ ID NO: 4312 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDAGGEPPSMTQLLRR

SEQ ID NO: 4313 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDAGSEPPSMTQLLRR

SEQ ID NO: 4314 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDAGAEPPSMTQLLRR

SEQ ID NO: 4315 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDASGEPPSMTQLLRR

SEQ ID NO: 4316 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDASSEPPSMTQLLRR

SEQ ID NO: 4317 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDASAEPPSMTQLLRR

SEQ ID NO: 4318 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDAAGEPPSMTQLLRR

SEQ ID NO: 4319 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDAASEPPSMTQLLRR

SEQ ID NO: 4320 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKNGVSNKDIEKETAKDAAAEPPSMTQLLRR

SEQ ID NO: 4321 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDGGGEPPSMTQLLRR

SEQ ID NO: 4322 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDGGSEPPSMTQLLRR

SEQ ID NO: 4323 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDGGAEPPSMTQLLRR

SEQ ID NO: 4324 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDGSGEPPSMTQLLRR

SEQ ID NO: 4325 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDGSSEPPSMTQLLRR

SEQ ID NO: 4326 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDGSAEPPSMTQLLRR

SEQ ID NO: 4327 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDGAGEPPSMTQLLRR

SEQ ID NO: 4328 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDGASEPPSMTQLLRR

SEQ ID NO: 4329 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDGAAEPPSMTQLLRR

SEQ ID NO: 4330 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDSGGEPPSMTQLLRR

SEQ ID NO: 4331 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDSGSEPPSMTQLLRR

SEQ ID NO: 4332 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDSGAEPPSMTQLLRR

SEQ ID NO: 4333 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDSSGEPPSMTQLLRR

SEQ ID NO: 4334 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDSSSEPPSMTQLLRR

SEQ ID NO: 4335 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDSSAEPPSMTQLLRR

SEQ ID NO: 4336 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDSAGEPPSMTQLLRR

SEQ ID NO: 4337 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDSASEPPSMTQLLRR

SEQ ID NO: 4338 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDSAAEPPSMTQLLRR

SEQ ID NO: 4339 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDAGGEPPSMTQLLRR

SEQ ID NO: 4340 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDAGSEPPSMTQLLRR

SEQ ID NO: 4341 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDAGAEPPSMTQLLRR

SEQ ID NO: 4342 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDASGEPPSMTQLLRR

SEQ ID NO: 4343 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDASSEPPSMTQLLRR

SEQ ID NO: 4344 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDASAEPPSMTQLLRR

SEQ ID NO: 4345 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDAAGEPPSMTQLLRR

SEQ ID NO: 4346 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDAASEPPSMTQLLRR

SEQ ID NO: 4347 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDHFGLRGLLHLENASYGIEPLQNSSHFEHIIYRMDDVYKEPLKMGVSNKDIEKETAKDAAAEPPSMTQLLRR

SEQ ID NO: 4348 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDGGGEPPSMTQLLRR

SEQ ID NO: 4349 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDGGSEPPSMTQLLRR

SEQ ID NO: 4350 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDGGAEPPSMTQLLRR

SEQ ID NO: 4351 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDGSGEPPSMTQLLRR

SEQ ID NO: 4352 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDGSSEPPSMTQLLRR

SEQ ID NO: 4353 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDGSAEPPSMTQLLRR

SEQ ID NO: 4354 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDGAGEPPSMTQLLRR

SEQ ID NO: 4355 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDGASEPPSMTQLLRR

SEQ ID NO: 4356 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDGAAEPPSMTQLLRR

SEQ ID NO: 4357 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDSGGEPPSMTQLLRR

SEQ ID NO: 4358 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDSGSEPPSMTQLLRR

SEQ ID NO: 4359 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDSGAEPPSMTQLLRR

SEQ ID NO: 4360 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDSSGEPPSMTQLLRR

SEQ ID NO: 4361 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDSSSEPPSMTQLLRR

SEQ ID NO: 4362 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDSSAEPPSMTQLLRR

SEQ ID NO: 4363 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDSAGEPPSMTQLLRR

SEQ ID NO: 4364 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDSASEPPSMTQLLRR

SEQ ID NO: 4365 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDSAAEPPSMTQLLRR

SEQ ID NO: 4366 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDAGGEPPSMTQLLRR

SEQ ID NO: 4367 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDAGSEPPSMTQLLRR

SEQ ID NO: 4368 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDAGAEPPSMTQLLRR

SEQ ID NO: 4369 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDASGEPPSMTQLLRR

SEQ ID NO: 4370 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDASSEPPSMTQLLRR

SEQ ID NO: 4371 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDASAEPPSMTQLLRR

SEQ ID NO: 4372 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDAAGEPPSMTQLLRR

SEQ ID NO: 4373 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDAASEPPSMTQLLRR

SEQ ID NO: 4374 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKCGVSNKDIEKETAKDAAAEPPSMTQLLRR

SEQ ID NO: 4375 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDGGGEPPSMTQLLRR

SEQ ID NO: 4376 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDGGSEPPSMTQLLRR

SEQ ID NO: 4377 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDGGAEPPSMTQLLRR

SEQ ID NO: 4378 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDGSGEPPSMTQLLRR

SEQ ID NO: 4379 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDGSSEPPSMTQLLRR

SEQ ID NO: 4380 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDGSAEPPSMTQLLRR

SEQ ID NO: 4381 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDGAGEPPSMTQLLRR

SEQ ID NO: 4382 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDGASEPPSMTQLLRR

SEQ ID NO: 4383 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDGAAEPPSMTQLLRR

SEQ ID NO: 4384 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDSGGEPPSMTQLLRR

SEQ ID NO: 4385 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDSGSEPPSMTQLLRR

SEQ ID NO: 4386 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDSGAEPPSMTQLLRR

SEQ ID NO: 4387 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDSSGEPPSMTQLLRR

SEQ ID NO: 4388 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDSSSEPPSMTQLLRR

SEQ ID NO: 4389 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDSSAEPPSMTQLLRR

SEQ ID NO: 4390 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDSAGEPPSMTQLLRR

SEQ ID NO: 4391 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDSASEPPSMTQLLRR

SEQ ID NO: 4392 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDSAAEPPSMTQLLRR

SEQ ID NO: 4393 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDAGGEPPSMTQLLRR

SEQ ID NO: 4394 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDAGSEPPSMTQLLRR

SEQ ID NO: 4395 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDAGAEPPSMTQLLRR

SEQ ID NO: 4396 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDASGEPPSMTQLLRR

SEQ ID NO: 4397 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDASSEPPSMTQLLRR

SEQ ID NO: 4398 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDASAEPPSMTQLLRR

SEQ ID NO: 4399 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDAAGEPPSMTQLLRR

SEQ ID NO: 4400 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDAASEPPSMTQLLRR

SEQ ID NO: 4401 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKSGVSNKDIEKETAKDAAAEPPSMTQLLRR

SEQ ID NO: 4402 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDGGGEPPSMTQLLRR

SEQ ID NO: 4403 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDGGSEPPSMTQLLRR

SEQ ID NO: 4404 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDGGAEPPSMTQLLRR

SEQ ID NO: 4405 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDGSGEPPSMTQLLRR

SEQ ID NO: 4406 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDGSSEPPSMTQLLRR

SEQ ID NO: 4407 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDGSAEPPSMTQLLRR

SEQ ID NO: 4408 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDGAGEPPSMTQLLRR

SEQ ID NO: 4409 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDGASEPPSMTQLLRR

SEQ ID NO: 4410 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDGAAEPPSMTQLLRR

SEQ ID NO: 4411 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDSGGEPPSMTQLLRR

SEQ ID NO: 4412 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDSGSEPPSMTQLLRR

SEQ ID NO: 4413 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDSGAEPPSMTQLLRR

SEQ ID NO: 4414 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDSSGEPPSMTQLLRR

SEQ ID NO: 4415 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDSSSEPPSMTQLLRR

SEQ ID NO: 4416 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDSSAEPPSMTQLLRR

SEQ ID NO: 4417 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDSAGEPPSMTQLLRR

SEQ ID NO: 4418 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDSASEPPSMTQLLRR

SEQ ID NO: 4419 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDSAAEPPSMTQLLRR

SEQ ID NO: 4420 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDAGGEPPSMTQLLRR

SEQ ID NO: 4421 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDAGSEPPSMTQLLRR

SEQ ID NO: 4422 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDAGAEPPSMTQLLRR

SEQ ID NO: 4423 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDASGEPPSMTQLLRR

SEQ ID NO: 4424 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDASSEPPSMTQLLRR

SEQ ID NO: 4425 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDASAEPPSMTQLLRR

SEQ ID NO: 4426 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDAAGEPPSMTQLLRR

SEQ ID NO: 4427 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDAASEPPSMTQLLRR

SEQ ID NO: 4428 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKAGVSNKDIEKETAKDAAAEPPSMTQLLRR

SEQ ID NO: 4429 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDGGGEPPSMTQLLRR

SEQ ID NO: 4430 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDGGSEPPSMTQLLRR

SEQ ID NO: 4431 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDGGAEPPSMTQLLRR

SEQ ID NO: 4432 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDGSGEPPSMTQLLRR

SEQ ID NO: 4433 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDGSSEPPSMTQLLRR

SEQ ID NO: 4434 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDGSAEPPSMTQLLRR

SEQ ID NO: 4435 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDGAGEPPSMTQLLRR

SEQ ID NO: 4436 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDGASEPPSMTQLLRR

SEQ ID NO: 4437 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDGAAEPPSMTQLLRR

SEQ ID NO: 4438 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDSGGEPPSMTQLLRR

SEQ ID NO: 4439 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDSGSEPPSMTQLLRR

SEQ ID NO: 4440 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDSGAEPPSMTQLLRR

SEQ ID NO: 4441 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDSSGEPPSMTQLLRR

SEQ ID NO: 4442 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDSSSEPPSMTQLLRR

SEQ ID NO: 4443 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDSSAEPPSMTQLLRR

SEQ ID NO: 4444 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDSAGEPPSMTQLLRR

SEQ ID NO: 4445 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDSASEPPSMTQLLRR

SEQ ID NO: 4446 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDSAAEPPSMTQLLRR

SEQ ID NO: 4447 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDAGGEPPSMTQLLRR

SEQ ID NO: 4448 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDAGSEPPSMTQLLRR

SEQ ID NO: 4449 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDAGAEPPSMTQLLRR

SEQ ID NO: 4450 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDASGEPPSMTQLLRR

SEQ ID NO: 4451 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDASSEPPSMTQLLRR

SEQ ID NO: 4452 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDASAEPPSMTQLLRR

SEQ ID NO: 4453 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDAAGEPPSMTQLLRR

SEQ ID NO: 4454 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDAASEPPSMTQLLRR

SEQ ID NO: 4455 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKGGVSNKDIEKETAKDAAAEPPSMTQLLRR

SEQ ID NO: 4456 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDGGGEPPSMTQLLRR

SEQ ID NO: 4457 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDGGSEPPSMTQLLRR

SEQ ID NO: 4458 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDGGAEPPSMTQLLRR

SEQ ID NO: 4459 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDGSGEPPSMTQLLRR

SEQ ID NO: 4460 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDGSSEPPSMTQLLRR

SEQ ID NO: 4461 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDGSAEPPSMTQLLRR

SEQ ID NO: 4462 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDGAGEPPSMTQLLRR

SEQ ID NO: 4463 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDGASEPPSMTQLLRR

SEQ ID NO: 4464 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDGAAEPPSMTQLLRR

SEQ ID NO: 4465 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDSGGEPPSMTQLLRR

SEQ ID NO: 4466 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDSGSEPPSMTQLLRR

SEQ ID NO: 4467 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDSGAEPPSMTQLLRR

SEQ ID NO: 4468 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDSSGEPPSMTQLLRR

SEQ ID NO: 4469 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDSSSEPPSMTQLLRR

SEQ ID NO: 4470 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDSSAEPPSMTQLLRR

SEQ ID NO: 4471 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDSAGEPPSMTQLLRR

SEQ ID NO: 4472 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDSASEPPSMTQLLRR

SEQ ID NO: 4473 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDSAAEPPSMTQLLRR

SEQ ID NO: 4474 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDAGGEPPSMTQLLRR

SEQ ID NO: 4475 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDAGSEPPSMTQLLRR

SEQ ID NO: 4476 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDAGAEPPSMTQLLRR

SEQ ID NO: 4477 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDASGEPPSMTQLLRR

SEQ ID NO: 4478 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDASSEPPSMTQLLRR

SEQ ID NO: 4479 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDASAEPPSMTQLLRR

SEQ ID NO: 4480 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDAAGEPPSMTQLLRR

SEQ ID NO: 4481 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDAASEPPSMTQLLRR

SEQ ID NO: 4482 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKDGVSNKDIEKETAKDAAAEPPSMTQLLRR

SEQ ID NO: 4483 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDGGGEPPSMTQLLRR

SEQ ID NO: 4484 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDGGSEPPSMTQLLRR

SEQ ID NO: 4485 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDGGAEPPSMTQLLRR

SEQ ID NO: 4486 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDGSGEPPSMTQLLRR

SEQ ID NO: 4487 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDGSSEPPSMTQLLRR

SEQ ID NO: 4488 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDGSAEPPSMTQLLRR

SEQ ID NO: 4489 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDGAGEPPSMTQLLRR

SEQ ID NO: 4490 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDGASEPPSMTQLLRR

SEQ ID NO: 4491 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDGAAEPPSMTQLLRR

SEQ ID NO: 4492 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDSGGEPPSMTQLLRR

SEQ ID NO: 4493 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDSGSEPPSMTQLLRR

SEQ ID NO: 4494 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDSGAEPPSMTQLLRR

SEQ ID NO: 4495 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDSSGEPPSMTQLLRR

SEQ ID NO: 4496 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDSSSEPPSMTQLLRR

SEQ ID NO: 4497 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDSSAEPPSMTQLLRR

SEQ ID NO: 4498 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDSAGEPPSMTQLLRR

SEQ ID NO: 4499 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDSASEPPSMTQLLRR

SEQ ID NO: 4500 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDSAAEPPSMTQLLRR

SEQ ID NO: 4501 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDAGGEPPSMTQLLRR

SEQ ID NO: 4502 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDAGSEPPSMTQLLRR

SEQ ID NO: 4503 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDAGAEPPSMTQLLRR

SEQ ID NO: 4504 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDASGEPPSMTQLLRR

SEQ ID NO: 4505 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDASSEPPSMTQLLRR

SEQ ID NO: 4506 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDASAEPPSMTQLLRR

SEQ ID NO: 4507 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDAAGEPPSMTQLLRR

SEQ ID NO: 4508 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDAASEPPSMTQLLRR

SEQ ID NO: 4509 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKHGVSNKDIEKETAKDAAAEPPSMTQLLRR

SEQ ID NO: 4510 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDGGGEPPSMTQLLRR

SEQ ID NO: 4511 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDGGSEPPSMTQLLRR

SEQ ID NO: 4512 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDGGAEPPSMTQLLRR

SEQ ID NO: 4513 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDGSGEPPSMTQLLRR

SEQ ID NO: 4514 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDGSSEPPSMTQLLRR

SEQ ID NO: 4515 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDGSAEPPSMTQLLRR

SEQ ID NO: 4516 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDGAGEPPSMTQLLRR

SEQ ID NO: 4517 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDGASEPPSMTQLLRR

SEQ ID NO: 4518 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDGAAEPPSMTQLLRR

SEQ ID NO: 4519 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDSGGEPPSMTQLLRR

SEQ ID NO: 4520 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDSGSEPPSMTQLLRR

SEQ ID NO: 4521 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDSGAEPPSMTQLLRR

SEQ ID NO: 4522 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDSSGEPPSMTQLLRR

SEQ ID NO: 4523 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDSSSEPPSMTQLLRR

SEQ ID NO: 4524 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDSSAEPPSMTQLLRR

SEQ ID NO: 4525 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDSAGEPPSMTQLLRR

SEQ ID NO: 4526 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDSASEPPSMTQLLRR

SEQ ID NO: 4527 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDSAAEPPSMTQLLRR

SEQ ID NO: 4528 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDAGGEPPSMTQLLRR

SEQ ID NO: 4529 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDAGSEPPSMTQLLRR

SEQ ID NO: 4530 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDAGAEPPSMTQLLRR

SEQ ID NO: 4531 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDASGEPPSMTQLLRR

SEQ ID NO: 4532 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDASSEPPSMTQLLRR

SEQ ID NO: 4533 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDASAEPPSMTQLLRR

SEQ ID NO: 4534 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDAAGEPPSMTQLLRR

SEQ ID NO: 4535 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDAASEPPSMTQLLRR

SEQ ID NO: 4536 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKYGVSNKDIEKETAKDAAAEPPSMTQLLRR

SEQ ID NO: 4537 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDGGGEPPSMTQLLRR

SEQ ID NO: 4538 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDGGSEPPSMTQLLRR

SEQ ID NO: 4539 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDGGAEPPSMTQLLRR

SEQ ID NO: 4540 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDGSGEPPSMTQLLRR

SEQ ID NO: 4541 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDGSSEPPSMTQLLRR

SEQ ID NO: 4542 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDGSAEPPSMTQLLRR

SEQ ID NO: 4543 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDGAGEPPSMTQLLRR

SEQ ID NO: 4544 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDGASEPPSMTQLLRR

SEQ ID NO: 4545 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDGAAEPPSMTQLLRR

SEQ ID NO: 4546 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDSGGEPPSMTQLLRR

SEQ ID NO: 4547 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDSGSEPPSMTQLLRR

SEQ ID NO: 4548 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDSGAEPPSMTQLLRR

SEQ ID NO: 4549 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDSSGEPPSMTQLLRR

SEQ ID NO: 4550 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDSSSEPPSMTQLLRR

SEQ ID NO: 4551 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDSSAEPPSMTQLLRR

SEQ ID NO: 4552 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDSAGEPPSMTQLLRR

SEQ ID NO: 4553 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDSASEPPSMTQLLRR

SEQ ID NO: 4554 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDSAAEPPSMTQLLRR

SEQ ID NO: 4555 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDAGGEPPSMTQLLRR

SEQ ID NO: 4556 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDAGSEPPSMTQLLRR

SEQ ID NO: 4557 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDAGAEPPSMTQLLRR

SEQ ID NO: 4558 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDASGEPPSMTQLLRR

SEQ ID NO: 4559 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDASSEPPSMTQLLRR

SEQ ID NO: 4560 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDASAEPPSMTQLLRR

SEQ ID NO: 4561 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDAAGEPPSMTQLLRR

SEQ ID NO: 4562 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDAASEPPSMTQLLRR

SEQ ID NO: 4563 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKKGVSNKDIEKETAKDAAAEPPSMTQLLRR

SEQ ID NO: 4564 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDGGGEPPSMTQLLRR

SEQ ID NO: 4565 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDGGSEPPSMTQLLRR

SEQ ID NO: 4566 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDGGAEPPSMTQLLRR

SEQ ID NO: 4567 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDGSGEPPSMTQLLRR

SEQ ID NO: 4568 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDGSSEPPSMTQLLRR

SEQ ID NO: 4569 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDGSAEPPSMTQLLRR

SEQ ID NO: 4570 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDGAGEPPSMTQLLRR

SEQ ID NO: 4571 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDGASEPPSMTQLLRR

SEQ ID NO: 4572 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDGAAEPPSMTQLLRR

SEQ ID NO: 4573 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDSGGEPPSMTQLLRR

SEQ ID NO: 4574 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDSGSEPPSMTQLLRR

SEQ ID NO: 4575 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDSGAEPPSMTQLLRR

SEQ ID NO: 4576 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDSSGEPPSMTQLLRR

SEQ ID NO: 4577 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDSSSEPPSMTQLLRR

SEQ ID NO: 4578 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDSSAEPPSMTQLLRR

SEQ ID NO: 4579 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDSAGEPPSMTQLLRR

SEQ ID NO: 4580 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDSASEPPSMTQLLRR

SEQ ID NO: 4581 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDSAAEPPSMTQLLRR

SEQ ID NO: 4582 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDAGGEPPSMTQLLRR

SEQ ID NO: 4583 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDAGSEPPSMTQLLRR

SEQ ID NO: 4584 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDAGAEPPSMTQLLRR

SEQ ID NO: 4585 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDASGEPPSMTQLLRR

SEQ ID NO: 4586 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDASSEPPSMTQLLRR

SEQ ID NO: 4587 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDASAEPPSMTQLLRR

SEQ ID NO: 4588 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDAAGEPPSMTQLLRR

SEQ ID NO: 4589 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDAASEPPSMTQLLRR

SEQ ID NO: 4590 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKNGVSNKDIEKETAKDAAAEPPSMTQLLRR

SEQ ID NO: 4591 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDGGGEPPSMTQLLRR

SEQ ID NO: 4592 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDGGSEPPSMTQLLRR

SEQ ID NO: 4593 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDGGAEPPSMTQLLRR

SEQ ID NO: 4594 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDGSGEPPSMTQLLRR

SEQ ID NO: 4595 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDGSSEPPSMTQLLRR

SEQ ID NO: 4596 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDGSAEPPSMTQLLRR

SEQ ID NO: 4597 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDGAGEPPSMTQLLRR

SEQ ID NO: 4598 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDGASEPPSMTQLLRR

SEQ ID NO: 4599 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDGAAEPPSMTQLLRR

SEQ ID NO: 4600 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDSGGEPPSMTQLLRR

SEQ ID NO: 4601 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDSGSEPPSMTQLLRR

SEQ ID NO: 4602 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDSGAEPPSMTQLLRR

SEQ ID NO: 4603 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDSSGEPPSMTQLLRR

SEQ ID NO: 4604 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDSSSEPPSMTQLLRR

SEQ ID NO: 4605 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDSSAEPPSMTQLLRR

SEQ ID NO: 4606 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDSAGEPPSMTQLLRR

SEQ ID NO: 4607 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDSASEPPSMTQLLRR

SEQ ID NO: 4608 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDSAAEPPSMTQLLRR

SEQ ID NO: 4609 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDAGGEPPSMTQLLRR

SEQ ID NO: 4610 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDAGSEPPSMTQLLRR

SEQ ID NO: 4611 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDAGAEPPSMTQLLRR

SEQ ID NO: 4612 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDASGEPPSMTQLLRR

SEQ ID NO: 4613 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDASSEPPSMTQLLRR

SEQ ID NO: 4614 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDASAEPPSMTQLLRR

SEQ ID NO: 4615 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDAAGEPPSMTQLLRR

SEQ ID NO: 4616 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDAASEPPSMTQLLRR

SEQ ID NO: 4617 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDYFGLRGLLHLENASYGIEPLQNSSHFEHIIYRMDDVYKEPLKMGVSNKDIEKETAKDAAAEPPSMTQLLRR

SEQ ID NO: 4618 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDGGGEPPSMTQLLRR

SEQ ID NO: 4619 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDGGSEPPSMTQLLRR

SEQ ID NO: 4620 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDGGAEPPSMTQLLRR

SEQ ID NO: 4621 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDGSGEPPSMTQLLRR

SEQ ID NO: 4622 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDGSSEPPSMTQLLRR

SEQ ID NO: 4623 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDGSAEPPSMTQLLRR

SEQ ID NO: 4624 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDGAGEPPSMTQLLRR

SEQ ID NO: 4625 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDGASEPPSMTQLLRR

SEQ ID NO: 4626 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDGAAEPPSMTQLLRR

SEQ ID NO: 4627 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDSGGEPPSMTQLLRR

SEQ ID NO: 4628 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDSGSEPPSMTQLLRR

SEQ ID NO: 4629 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDSGAEPPSMTQLLRR

SEQ ID NO: 4630 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDSSGEPPSMTQLLRR

SEQ ID NO: 4631 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDSSSEPPSMTQLLRR

SEQ ID NO: 4632 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDSSAEPPSMTQLLRR

SEQ ID NO: 4633 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDSAGEPPSMTQLLRR

SEQ ID NO: 4634 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDSASEPPSMTQLLRR

SEQ ID NO: 4635 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDSAAEPPSMTQLLRR

SEQ ID NO: 4636 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDAGGEPPSMTQLLRR

SEQ ID NO: 4637 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDAGSEPPSMTQLLRR

SEQ ID NO: 4638 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDAGAEPPSMTQLLRR

SEQ ID NO: 4639 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDASGEPPSMTQLLRR

SEQ ID NO: 4640 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDASSEPPSMTQLLRR

SEQ ID NO: 4641 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDASAEPPSMTQLLRR

SEQ ID NO: 4642 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDAAGEPPSMTQLLRR

SEQ ID NO: 4643 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDAASEPPSMTQLLRR

SEQ ID NO: 4644 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKCGVSNKDIEKETAKDAAAEPPSMTQLLRR

SEQ ID NO: 4645 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDGGGEPPSMTQLLRR

SEQ ID NO: 4646 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDGGSEPPSMTQLLRR

SEQ ID NO: 4647 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDGGAEPPSMTQLLRR

SEQ ID NO: 4648 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDGSGEPPSMTQLLRR

SEQ ID NO: 4649 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDGSSEPPSMTQLLRR

SEQ ID NO: 4650 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDGSAEPPSMTQLLRR

SEQ ID NO: 4651 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDGAGEPPSMTQLLRR

SEQ ID NO: 4652 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDGASEPPSMTQLLRR

SEQ ID NO: 4653 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDGAAEPPSMTQLLRR

SEQ ID NO: 4654 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDSGGEPPSMTQLLRR

SEQ ID NO: 4655 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDSGSEPPSMTQLLRR

SEQ ID NO: 4656 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDSGAEPPSMTQLLRR

SEQ ID NO: 4657 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDSSGEPPSMTQLLRR

SEQ ID NO: 4658 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDSSSEPPSMTQLLRR

SEQ ID NO: 4659 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDSSAEPPSMTQLLRR

SEQ ID NO: 4660 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDSAGEPPSMTQLLRR

SEQ ID NO: 4661 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDSASEPPSMTQLLRR

SEQ ID NO: 4662 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDSAAEPPSMTQLLRR

SEQ ID NO: 4663 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDAGGEPPSMTQLLRR

SEQ ID NO: 4664 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDAGSEPPSMTQLLRR

SEQ ID NO: 4665 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDAGAEPPSMTQLLRR

SEQ ID NO: 4666 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDASGEPPSMTQLLRR

SEQ ID NO: 4667 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDASSEPPSMTQLLRR

SEQ ID NO: 4668 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDASAEPPSMTQLLRR

SEQ ID NO: 4669 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDAAGEPPSMTQLLRR

SEQ ID NO: 4670 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDAASEPPSMTQLLRR

SEQ ID NO: 4671 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKSGVSNKDIEKETAKDAAAEPPSMTQLLRR

SEQ ID NO: 4672 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDGGGEPPSMTQLLRR

SEQ ID NO: 4673 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDGGSEPPSMTQLLRR

SEQ ID NO: 4674 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDGGAEPPSMTQLLRR

SEQ ID NO: 4675 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDGSGEPPSMTQLLRR

SEQ ID NO: 4676 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDGSSEPPSMTQLLRR

SEQ ID NO: 4677 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDGSAEPPSMTQLLRR

SEQ ID NO: 4678 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDGAGEPPSMTQLLRR

SEQ ID NO: 4679 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDGASEPPSMTQLLRR

SEQ ID NO: 4680 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDGAAEPPSMTQLLRR

SEQ ID NO: 4681 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDSGGEPPSMTQLLRR

SEQ ID NO: 4682 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDSGSEPPSMTQLLRR

SEQ ID NO: 4683 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDSGAEPPSMTQLLRR

SEQ ID NO: 4684 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDSSGEPPSMTQLLRR

SEQ ID NO: 4685 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDSSSEPPSMTQLLRR

SEQ ID NO: 4686 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDSSAEPPSMTQLLRR

SEQ ID NO: 4687 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDSAGEPPSMTQLLRR

SEQ ID NO: 4688 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDSASEPPSMTQLLRR

SEQ ID NO: 4689 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDSAAEPPSMTQLLRR

SEQ ID NO: 4690 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDAGGEPPSMTQLLRR

SEQ ID NO: 4691 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDAGSEPPSMTQLLRR

SEQ ID NO: 4692 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDAGAEPPSMTQLLRR

SEQ ID NO: 4693 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDASGEPPSMTQLLRR

SEQ ID NO: 4694 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDASSEPPSMTQLLRR

SEQ ID NO: 4695 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDASAEPPSMTQLLRR

SEQ ID NO: 4696 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDAAGEPPSMTQLLRR

SEQ ID NO: 4697 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDAASEPPSMTQLLRR

SEQ ID NO: 4698 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKAGVSNKDIEKETAKDAAAEPPSMTQLLRR

SEQ ID NO: 4699 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDGGGEPPSMTQLLRR

SEQ ID NO: 4700 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDGGSEPPSMTQLLRR

SEQ ID NO: 4701 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDGGAEPPSMTQLLRR

SEQ ID NO: 4702 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDGSGEPPSMTQLLRR

SEQ ID NO: 4703 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDGSSEPPSMTQLLRR

SEQ ID NO: 4704 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDGSAEPPSMTQLLRR

SEQ ID NO: 4705 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDGAGEPPSMTQLLRR

SEQ ID NO: 4706 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDGASEPPSMTQLLRR

SEQ ID NO: 4707 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDGAAEPPSMTQLLRR

SEQ ID NO: 4708 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDSGGEPPSMTQLLRR

SEQ ID NO: 4709 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDSGSEPPSMTQLLRR

SEQ ID NO: 4710 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDSGAEPPSMTQLLRR

SEQ ID NO: 4711 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDSSGEPPSMTQLLRR

SEQ ID NO: 4712 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDSSSEPPSMTQLLRR

SEQ ID NO: 4713 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDSSAEPPSMTQLLRR

SEQ ID NO: 4714 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDSAGEPPSMTQLLRR

SEQ ID NO: 4715 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDSASEPPSMTQLLRR

SEQ ID NO: 4716 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDSAAEPPSMTQLLRR

SEQ ID NO: 4717 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDAGGEPPSMTQLLRR

SEQ ID NO: 4718 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDAGSEPPSMTQLLRR

SEQ ID NO: 4719 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDAGAEPPSMTQLLRR

SEQ ID NO: 4720 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDASGEPPSMTQLLRR

SEQ ID NO: 4721 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDASSEPPSMTQLLRR

SEQ ID NO: 4722 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDASAEPPSMTQLLRR

SEQ ID NO: 4723 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDAAGEPPSMTQLLRR

SEQ ID NO: 4724 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDAASEPPSMTQLLRR

SEQ ID NO: 4725 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKGGVSNKDIEKETAKDAAAEPPSMTQLLRR

SEQ ID NO: 4726 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDGGGEPPSMTQLLRR

SEQ ID NO: 4727 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDGGSEPPSMTQLLRR

SEQ ID NO: 4728 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDGGAEPPSMTQLLRR

SEQ ID NO: 4729 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDGSGEPPSMTQLLRR

SEQ ID NO: 4730 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDGSSEPPSMTQLLRR

SEQ ID NO: 4731 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDGSAEPPSMTQLLRR

SEQ ID NO: 4732 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDGAGEPPSMTQLLRR

SEQ ID NO: 4733 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDGASEPPSMTQLLRR

SEQ ID NO: 4734 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDGAAEPPSMTQLLRR

SEQ ID NO: 4735 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDSGGEPPSMTQLLRR

SEQ ID NO: 4736 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDSGSEPPSMTQLLRR

SEQ ID NO: 4737 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDSGAEPPSMTQLLRR

SEQ ID NO: 4738 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDSSGEPPSMTQLLRR

SEQ ID NO: 4739 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDSSSEPPSMTQLLRR

SEQ ID NO: 4740 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDSSAEPPSMTQLLRR

SEQ ID NO: 4741 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDSAGEPPSMTQLLRR

SEQ ID NO: 4742 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDSASEPPSMTQLLRR

SEQ ID NO: 4743 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDSAAEPPSMTQLLRR

SEQ ID NO: 4744 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDAGGEPPSMTQLLRR

SEQ ID NO: 4745 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDAGSEPPSMTQLLRR

SEQ ID NO: 4746 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDAGAEPPSMTQLLRR

SEQ ID NO: 4747 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDASGEPPSMTQLLRR

SEQ ID NO: 4748 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDASSEPPSMTQLLRR

SEQ ID NO: 4749 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDASAEPPSMTQLLRR

SEQ ID NO: 4750 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDAAGEPPSMTQLLRR

SEQ ID NO: 4751 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDAASEPPSMTQLLRR

SEQ ID NO: 4752 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKDGVSNKDIEKETAKDAAAEPPSMTQLLRR

SEQ ID NO: 4753 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDGGGEPPSMTQLLRR

SEQ ID NO: 4754 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDGGSEPPSMTQLLRR

SEQ ID NO: 4755 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDGGAEPPSMTQLLRR

SEQ ID NO: 4756 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDGSGEPPSMTQLLRR

SEQ ID NO: 4757 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDGSSEPPSMTQLLRR

SEQ ID NO: 4758 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDGSAEPPSMTQLLRR

SEQ ID NO: 4759 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDGAGEPPSMTQLLRR

SEQ ID NO: 4760 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDGASEPPSMTQLLRR

SEQ ID NO: 4761 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDGAAEPPSMTQLLRR

SEQ ID NO: 4762 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDSGGEPPSMTQLLRR

SEQ ID NO: 4763 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDSGSEPPSMTQLLRR

SEQ ID NO: 4764 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDSGAEPPSMTQLLRR

SEQ ID NO: 4765 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDSSGEPPSMTQLLRR

SEQ ID NO: 4766 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDSSSEPPSMTQLLRR

SEQ ID NO: 4767 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDSSAEPPSMTQLLRR

SEQ ID NO: 4768 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDSAGEPPSMTQLLRR

SEQ ID NO: 4769 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDSASEPPSMTQLLRR

SEQ ID NO: 4770 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDSAAEPPSMTQLLRR

SEQ ID NO: 4771 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDAGGEPPSMTQLLRR

SEQ ID NO: 4772 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDAGSEPPSMTQLLRR

SEQ ID NO: 4773 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDAGAEPPSMTQLLRR

SEQ ID NO: 4774 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDASGEPPSMTQLLRR

SEQ ID NO: 4775 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDASSEPPSMTQLLRR

SEQ ID NO: 4776 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDASAEPPSMTQLLRR

SEQ ID NO: 4777 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDAAGEPPSMTQLLRR

SEQ ID NO: 4778 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDAASEPPSMTQLLRR

SEQ ID NO: 4779 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKHGVSNKDIEKETAKDAAAEPPSMTQLLRR

SEQ ID NO: 4780 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDGGGEPPSMTQLLRR

SEQ ID NO: 4781 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDGGSEPPSMTQLLRR

SEQ ID NO: 4782 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDGGAEPPSMTQLLRR

SEQ ID NO: 4783 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDGSGEPPSMTQLLRR

SEQ ID NO: 4784 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDGSSEPPSMTQLLRR

SEQ ID NO: 4785 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDGSAEPPSMTQLLRR

SEQ ID NO: 4786 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDGAGEPPSMTQLLRR

SEQ ID NO: 4787 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDGASEPPSMTQLLRR

SEQ ID NO: 4788 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDGAAEPPSMTQLLRR

SEQ ID NO: 4789 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDSGGEPPSMTQLLRR

SEQ ID NO: 4790 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDSGSEPPSMTQLLRR

SEQ ID NO: 4791 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDSGAEPPSMTQLLRR

SEQ ID NO: 4792 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDSSGEPPSMTQLLRR

SEQ ID NO: 4793 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDSSSEPPSMTQLLRR

SEQ ID NO: 4794 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDSSAEPPSMTQLLRR

SEQ ID NO: 4795 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDSAGEPPSMTQLLRR

SEQ ID NO: 4796 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDSASEPPSMTQLLRR

SEQ ID NO: 4797 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDSAAEPPSMTQLLRR

SEQ ID NO: 4798 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDAGGEPPSMTQLLRR

SEQ ID NO: 4799 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDAGSEPPSMTQLLRR

SEQ ID NO: 4800 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDAGAEPPSMTQLLRR

SEQ ID NO: 4801 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDASGEPPSMTQLLRR

SEQ ID NO: 4802 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDASSEPPSMTQLLRR

SEQ ID NO: 4803 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDASAEPPSMTQLLRR

SEQ ID NO: 4804 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDAAGEPPSMTQLLRR

SEQ ID NO: 4805 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDAASEPPSMTQLLRR

SEQ ID NO: 4806 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKYGVSNKDIEKETAKDAAAEPPSMTQLLRR

SEQ ID NO: 4807 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDGGGEPPSMTQLLRR

SEQ ID NO: 4808 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDGGSEPPSMTQLLRR

SEQ ID NO: 4809 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDGGAEPPSMTQLLRR

SEQ ID NO: 4810 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDGSGEPPSMTQLLRR

SEQ ID NO: 4811 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDGSSEPPSMTQLLRR

SEQ ID NO: 4812 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDGSAEPPSMTQLLRR

SEQ ID NO: 4813 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDGAGEPPSMTQLLRR

SEQ ID NO: 4814 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDGASEPPSMTQLLRR

SEQ ID NO: 4815 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDGAAEPPSMTQLLRR

SEQ ID NO: 4816 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDSGGEPPSMTQLLRR

SEQ ID NO: 4817 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDSGSEPPSMTQLLRR

SEQ ID NO: 4818 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDSGAEPPSMTQLLRR

SEQ ID NO: 4819 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDSSGEPPSMTQLLRR

SEQ ID NO: 4820 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDSSSEPPSMTQLLRR

SEQ ID NO: 4821 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDSSAEPPSMTQLLRR

SEQ ID NO: 4822 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDSAGEPPSMTQLLRR

SEQ ID NO: 4823 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDSASEPPSMTQLLRR

SEQ ID NO: 4824 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDSAAEPPSMTQLLRR

SEQ ID NO: 4825 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDAGGEPPSMTQLLRR

SEQ ID NO: 4826 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDAGSEPPSMTQLLRR

SEQ ID NO: 4827 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDAGAEPPSMTQLLRR

SEQ ID NO: 4828 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDASGEPPSMTQLLRR

SEQ ID NO: 4829 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDASSEPPSMTQLLRR

SEQ ID NO: 4830 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDASAEPPSMTQLLRR

SEQ ID NO: 4831 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDAAGEPPSMTQLLRR

SEQ ID NO: 4832 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDAASEPPSMTQLLRR

SEQ ID NO: 4833 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKKGVSNKDIEKETAKDAAAEPPSMTQLLRR

SEQ ID NO: 4834 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDGGGEPPSMTQLLRR

SEQ ID NO: 4835 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDGGSEPPSMTQLLRR

SEQ ID NO: 4836 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDGGAEPPSMTQLLRR

SEQ ID NO: 4837 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDGSGEPPSMTQLLRR

SEQ ID NO: 4838 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDGSSEPPSMTQLLRR

SEQ ID NO: 4839 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDGSAEPPSMTQLLRR

SEQ ID NO: 4840 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDGAGEPPSMTQLLRR

SEQ ID NO: 4841 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDGASEPPSMTQLLRR

SEQ ID NO: 4842 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDGAAEPPSMTQLLRR

SEQ ID NO: 4843 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDSGGEPPSMTQLLRR

SEQ ID NO: 4844 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDSGSEPPSMTQLLRR

SEQ ID NO: 4845 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDSGAEPPSMTQLLRR

SEQ ID NO: 4846 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDSSGEPPSMTQLLRR

SEQ ID NO: 4847 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDSSSEPPSMTQLLRR

SEQ ID NO: 4848 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDSSAEPPSMTQLLRR

SEQ ID NO: 4849 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDSAGEPPSMTQLLRR

SEQ ID NO: 4850 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDSASEPPSMTQLLRR

SEQ ID NO: 4851 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDSAAEPPSMTQLLRR

SEQ ID NO: 4852 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDAGGEPPSMTQLLRR

SEQ ID NO: 4853 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDAGSEPPSMTQLLRR

SEQ ID NO: 4854 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDAGAEPPSMTQLLRR

SEQ ID NO: 4855 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDASGEPPSMTQLLRR

SEQ ID NO: 4856 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDASSEPPSMTQLLRR

SEQ ID NO: 4857 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDASAEPPSMTQLLRR

SEQ ID NO: 4858 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDAAGEPPSMTQLLRR

SEQ ID NO: 4859 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDAASEPPSMTQLLRR

SEQ ID NO: 4860 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKNGVSNKDIEKETAKDAAAEPPSMTQLLRR

SEQ ID NO: 4861 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDGGGEPPSMTQLLRR

SEQ ID NO: 4862 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDGGSEPPSMTQLLRR

SEQ ID NO: 4863 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDGGAEPPSMTQLLRR

SEQ ID NO: 4864 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDGSGEPPSMTQLLRR

SEQ ID NO: 4865 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDGSSEPPSMTQLLRR

SEQ ID NO: 4866 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDGSAEPPSMTQLLRR

SEQ ID NO: 4867 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDGAGEPPSMTQLLRR

SEQ ID NO: 4868 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDGASEPPSMTQLLRR

SEQ ID NO: 4869 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDGAAEPPSMTQLLRR

SEQ ID NO: 4870 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDSGGEPPSMTQLLRR

SEQ ID NO: 4871 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDSGSEPPSMTQLLRR

SEQ ID NO: 4872 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDSGAEPPSMTQLLRR

SEQ ID NO: 4873 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDSSGEPPSMTQLLRR

SEQ ID NO: 4874 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDSSSEPPSMTQLLRR

SEQ ID NO: 4875 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDSSAEPPSMTQLLRR

SEQ ID NO: 4876 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDSAGEPPSMTQLLRR

SEQ ID NO: 4877 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDSASEPPSMTQLLRR

SEQ ID NO: 4878 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDSAAEPPSMTQLLRR

SEQ ID NO: 4879 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDAGGEPPSMTQLLRR

SEQ ID NO: 4880 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDAGSEPPSMTQLLRR

SEQ ID NO: 4881 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDAGAEPPSMTQLLRR

SEQ ID NO: 4882 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDASGEPPSMTQLLRR

SEQ ID NO: 4883 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDASSEPPSMTQLLRR

SEQ ID NO: 4884 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDASAEPPSMTQLLRR

SEQ ID NO: 4885 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDAAGEPPSMTQLLRR

SEQ ID NO: 4886 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDAASEPPSMTQLLRR

SEQ ID NO: 4887 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDKFGLRGLLHLENASYGIEPLQNSSHFEHIIYRMDDVYKEPLKMGVSNKDIEKETAKDAAAEPPSMTQLLRR

SEQ ID NO: 4888 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDGGGEPPSMTQLLRR

SEQ ID NO: 4889 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDGGSEPPSMTQLLRR

SEQ ID NO: 4890 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDGGAEPPSMTQLLRR

SEQ ID NO: 4891 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDGSGEPPSMTQLLRR

SEQ ID NO: 4892 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDGSSEPPSMTQLLRR

SEQ ID NO: 4893 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDGSAEPPSMTQLLRR

SEQ ID NO: 4894 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDGAGEPPSMTQLLRR

SEQ ID NO: 4895 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDGASEPPSMTQLLRR

SEQ ID NO: 4896 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDGAAEPPSMTQLLRR

SEQ ID NO: 4897 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDSGGEPPSMTQLLRR

SEQ ID NO: 4898 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDSGSEPPSMTQLLRR

SEQ ID NO: 4899 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDSGAEPPSMTQLLRR

SEQ ID NO: 4900 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDSSGEPPSMTQLLRR

SEQ ID NO: 4901 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDSSSEPPSMTQLLRR

SEQ ID NO: 4902 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDSSAEPPSMTQLLRR

SEQ ID NO: 4903 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDSAGEPPSMTQLLRR

SEQ ID NO: 4904 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDSASEPPSMTQLLRR

SEQ ID NO: 4905 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDSAAEPPSMTQLLRR

SEQ ID NO: 4906 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDAGGEPPSMTQLLRR

SEQ ID NO: 4907 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDAGSEPPSMTQLLRR

SEQ ID NO: 4908 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDAGAEPPSMTQLLRR

SEQ ID NO: 4909 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDASGEPPSMTQLLRR

SEQ ID NO: 4910 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDASSEPPSMTQLLRR

SEQ ID NO: 4911 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDASAEPPSMTQLLRR

SEQ ID NO: 4912 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDAAGEPPSMTQLLRR

SEQ ID NO: 4913 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDAASEPPSMTQLLRR

SEQ ID NO: 4914 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKCGVSNKDIEKETAKDAAAEPPSMTQLLRR

SEQ ID NO: 4915 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDGGGEPPSMTQLLRR

SEQ ID NO: 4916 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDGGSEPPSMTQLLRR

SEQ ID NO: 4917 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDGGAEPPSMTQLLRR

SEQ ID NO: 4918 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDGSGEPPSMTQLLRR

SEQ ID NO: 4919 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDGSSEPPSMTQLLRR

SEQ ID NO: 4920 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDGSAEPPSMTQLLRR

SEQ ID NO: 4921 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDGAGEPPSMTQLLRR

SEQ ID NO: 4922 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDGASEPPSMTQLLRR

SEQ ID NO: 4923 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDGAAEPPSMTQLLRR

SEQ ID NO: 4924 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDSGGEPPSMTQLLRR

SEQ ID NO: 4925 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDSGSEPPSMTQLLRR

SEQ ID NO: 4926 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDSGAEPPSMTQLLRR

SEQ ID NO: 4927 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDSSGEPPSMTQLLRR

SEQ ID NO: 4928 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDSSSEPPSMTQLLRR

SEQ ID NO: 4929 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDSSAEPPSMTQLLRR

SEQ ID NO: 4930 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDSAGEPPSMTQLLRR

SEQ ID NO: 4931 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDSASEPPSMTQLLRR

SEQ ID NO: 4932 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDSAAEPPSMTQLLRR

SEQ ID NO: 4933 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDAGGEPPSMTQLLRR

SEQ ID NO: 4934 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDAGSEPPSMTQLLRR

SEQ ID NO: 4935 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDAGAEPPSMTQLLRR

SEQ ID NO: 4936 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDASGEPPSMTQLLRR

SEQ ID NO: 4937 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDASSEPPSMTQLLRR

SEQ ID NO: 4938 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDASAEPPSMTQLLRR

SEQ ID NO: 4939 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDAAGEPPSMTQLLRR

SEQ ID NO: 4940 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDAASEPPSMTQLLRR

SEQ ID NO: 4941 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKSGVSNKDIEKETAKDAAAEPPSMTQLLRR

SEQ ID NO: 4942 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDGGGEPPSMTQLLRR

SEQ ID NO: 4943 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDGGSEPPSMTQLLRR

SEQ ID NO: 4944 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDGGAEPPSMTQLLRR

SEQ ID NO: 4945 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDGSGEPPSMTQLLRR

SEQ ID NO: 4946 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDGSSEPPSMTQLLRR

SEQ ID NO: 4947 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDGSAEPPSMTQLLRR

SEQ ID NO: 4948 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDGAGEPPSMTQLLRR

SEQ ID NO: 4949 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDGASEPPSMTQLLRR

SEQ ID NO: 4950 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDGAAEPPSMTQLLRR

SEQ ID NO: 4951 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDSGGEPPSMTQLLRR

SEQ ID NO: 4952 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDSGSEPPSMTQLLRR

SEQ ID NO: 4953 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDSGAEPPSMTQLLRR

SEQ ID NO: 4954 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDSSGEPPSMTQLLRR

SEQ ID NO: 4955 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDSSSEPPSMTQLLRR

SEQ ID NO: 4956 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDSSAEPPSMTQLLRR

SEQ ID NO: 4957 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDSAGEPPSMTQLLRR

SEQ ID NO: 4958 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDSASEPPSMTQLLRR

SEQ ID NO: 4959 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDSAAEPPSMTQLLRR

SEQ ID NO: 4960 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDAGGEPPSMTQLLRR

SEQ ID NO: 4961 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDAGSEPPSMTQLLRR

SEQ ID NO: 4962 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDAGAEPPSMTQLLRR

SEQ ID NO: 4963 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDASGEPPSMTQLLRR

SEQ ID NO: 4964 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDASSEPPSMTQLLRR

SEQ ID NO: 4965 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDASAEPPSMTQLLRR

SEQ ID NO: 4966 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDAAGEPPSMTQLLRR

SEQ ID NO: 4967 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDAASEPPSMTQLLRR

SEQ ID NO: 4968 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKAGVSNKDIEKETAKDAAAEPPSMTQLLRR

SEQ ID NO: 4969 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDGGGEPPSMTQLLRR

SEQ ID NO: 4970 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDGGSEPPSMTQLLRR

SEQ ID NO: 4971 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDGGAEPPSMTQLLRR

SEQ ID NO: 4972 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDGSGEPPSMTQLLRR

SEQ ID NO: 4973 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDGSSEPPSMTQLLRR

SEQ ID NO: 4974 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDGSAEPPSMTQLLRR

SEQ ID NO: 4975 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDGAGEPPSMTQLLRR

SEQ ID NO: 4976 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDGASEPPSMTQLLRR

SEQ ID NO: 4977 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDGAAEPPSMTQLLRR

SEQ ID NO: 4978 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDSGGEPPSMTQLLRR

SEQ ID NO: 4979 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDSGSEPPSMTQLLRR

SEQ ID NO: 4980 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDSGAEPPSMTQLLRR

SEQ ID NO: 4981 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDSSGEPPSMTQLLRR

SEQ ID NO: 4982 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDSSSEPPSMTQLLRR

SEQ ID NO: 4983 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDSSAEPPSMTQLLRR

SEQ ID NO: 4984 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDSAGEPPSMTQLLRR

SEQ ID NO: 4985 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDSASEPPSMTQLLRR

SEQ ID NO: 4986 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDSAAEPPSMTQLLRR

SEQ ID NO: 4987 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDAGGEPPSMTQLLRR

SEQ ID NO: 4988 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDAGSEPPSMTQLLRR

SEQ ID NO: 4989 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDAGAEPPSMTQLLRR

SEQ ID NO: 4990 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDASGEPPSMTQLLRR

SEQ ID NO: 4991 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDASSEPPSMTQLLRR

SEQ ID NO: 4992 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDASAEPPSMTQLLRR

SEQ ID NO: 4993 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDAAGEPPSMTQLLRR

SEQ ID NO: 4994 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDAASEPPSMTQLLRR

SEQ ID NO: 4995 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKGGVSNKDIEKETAKDAAAEPPSMTQLLRR

SEQ ID NO: 4996 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDGGGEPPSMTQLLRR

SEQ ID NO: 4997 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDGGSEPPSMTQLLRR

SEQ ID NO: 4998 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDGGAEPPSMTQLLRR

SEQ ID NO: 4999 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDGSGEPPSMTQLLRR

SEQ ID NO: 5000 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDGSSEPPSMTQLLRR

SEQ ID NO: 5001 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDGSAEPPSMTQLLRR

SEQ ID NO: 5002 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDGAGEPPSMTQLLRR

SEQ ID NO: 5003 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDGASEPPSMTQLLRR

SEQ ID NO: 5004 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDGAAEPPSMTQLLRR

SEQ ID NO: 5005 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDSGGEPPSMTQLLRR

SEQ ID NO: 5006 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDSGSEPPSMTQLLRR

SEQ ID NO: 5007 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDSGAEPPSMTQLLRR

SEQ ID NO: 5008 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDSSGEPPSMTQLLRR

SEQ ID NO: 5009 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDSSSEPPSMTQLLRR

SEQ ID NO: 5010 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDSSAEPPSMTQLLRR

SEQ ID NO: 5011 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDSAGEPPSMTQLLRR

SEQ ID NO: 5012 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDSASEPPSMTQLLRR

SEQ ID NO: 5013 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDSAAEPPSMTQLLRR

SEQ ID NO: 5014 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDAGGEPPSMTQLLRR

SEQ ID NO: 5015 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDAGSEPPSMTQLLRR

SEQ ID NO: 5016 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDAGAEPPSMTQLLRR

SEQ ID NO: 5017 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDASGEPPSMTQLLRR

SEQ ID NO: 5018 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDASSEPPSMTQLLRR

SEQ ID NO: 5019 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDASAEPPSMTQLLRR

SEQ ID NO: 5020 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDAAGEPPSMTQLLRR

SEQ ID NO: 5021 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDAASEPPSMTQLLRR

SEQ ID NO: 5022 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKDGVSNKDIEKETAKDAAAEPPSMTQLLRR

SEQ ID NO: 5023 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDGGGEPPSMTQLLRR

SEQ ID NO: 5024 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDGGSEPPSMTQLLRR

SEQ ID NO: 5025 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDGGAEPPSMTQLLRR

SEQ ID NO: 5026 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDGSGEPPSMTQLLRR

SEQ ID NO: 5027 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDGSSEPPSMTQLLRR

SEQ ID NO: 5028 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDGSAEPPSMTQLLRR

SEQ ID NO: 5029 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDGAGEPPSMTQLLRR

SEQ ID NO: 5030 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDGASEPPSMTQLLRR

SEQ ID NO: 5031 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDGAAEPPSMTQLLRR

SEQ ID NO: 5032 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDSGGEPPSMTQLLRR

SEQ ID NO: 5033 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDSGSEPPSMTQLLRR

SEQ ID NO: 5034 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDSGAEPPSMTQLLRR

SEQ ID NO: 5035 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDSSGEPPSMTQLLRR

SEQ ID NO: 5036 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDSSSEPPSMTQLLRR

SEQ ID NO: 5037 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDSSAEPPSMTQLLRR

SEQ ID NO: 5038 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDSAGEPPSMTQLLRR

SEQ ID NO: 5039 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDSASEPPSMTQLLRR

SEQ ID NO: 5040 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDSAAEPPSMTQLLRR

SEQ ID NO: 5041 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDAGGEPPSMTQLLRR

SEQ ID NO: 5042 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDAGSEPPSMTQLLRR

SEQ ID NO: 5043 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDAGAEPPSMTQLLRR

SEQ ID NO: 5044 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDASGEPPSMTQLLRR

SEQ ID NO: 5045 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDASSEPPSMTQLLRR

SEQ ID NO: 5046 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDASAEPPSMTQLLRR

SEQ ID NO: 5047 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDAAGEPPSMTQLLRR

SEQ ID NO: 5048 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDAASEPPSMTQLLRR

SEQ ID NO: 5049 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKHGVSNKDIEKETAKDAAAEPPSMTQLLRR

SEQ ID NO: 5050 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDGGGEPPSMTQLLRR

SEQ ID NO: 5051 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDGGSEPPSMTQLLRR

SEQ ID NO: 5052 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDGGAEPPSMTQLLRR

SEQ ID NO: 5053 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDGSGEPPSMTQLLRR

SEQ ID NO: 5054 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDGSSEPPSMTQLLRR

SEQ ID NO: 5055 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDGSAEPPSMTQLLRR

SEQ ID NO: 5056 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDGAGEPPSMTQLLRR

SEQ ID NO: 5057 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDGASEPPSMTQLLRR

SEQ ID NO: 5058 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDGAAEPPSMTQLLRR

SEQ ID NO: 5059 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDSGGEPPSMTQLLRR

SEQ ID NO: 5060 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDSGSEPPSMTQLLRR

SEQ ID NO: 5061 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDSGAEPPSMTQLLRR

SEQ ID NO: 5062 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDSSGEPPSMTQLLRR

SEQ ID NO: 5063 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDSSSEPPSMTQLLRR

SEQ ID NO: 5064 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDSSAEPPSMTQLLRR

SEQ ID NO: 5065 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDSAGEPPSMTQLLRR

SEQ ID NO: 5066 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDSASEPPSMTQLLRR

SEQ ID NO: 5067 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDSAAEPPSMTQLLRR

SEQ ID NO: 5068 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDAGGEPPSMTQLLRR

SEQ ID NO: 5069 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDAGSEPPSMTQLLRR

SEQ ID NO: 5070 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDAGAEPPSMTQLLRR

SEQ ID NO: 5071 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDASGEPPSMTQLLRR

SEQ ID NO: 5072 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDASSEPPSMTQLLRR

SEQ ID NO: 5073 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDASAEPPSMTQLLRR

SEQ ID NO: 5074 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDAAGEPPSMTQLLRR

SEQ ID NO: 5075 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDAASEPPSMTQLLRR

SEQ ID NO: 5076 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKYGVSNKDIEKETAKDAAAEPPSMTQLLRR

SEQ ID NO: 5077 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDGGGEPPSMTQLLRR

SEQ ID NO: 5078 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDGGSEPPSMTQLLRR

SEQ ID NO: 5079 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDGGAEPPSMTQLLRR

SEQ ID NO: 5080 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDGSGEPPSMTQLLRR

SEQ ID NO: 5081 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDGSSEPPSMTQLLRR

SEQ ID NO: 5082 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDGSAEPPSMTQLLRR

SEQ ID NO: 5083 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDGAGEPPSMTQLLRR

SEQ ID NO: 5084 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDGASEPPSMTQLLRR

SEQ ID NO: 5085 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDGAAEPPSMTQLLRR

SEQ ID NO: 5086 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDSGGEPPSMTQLLRR

SEQ ID NO: 5087 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDSGSEPPSMTQLLRR

SEQ ID NO: 5088 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDSGAEPPSMTQLLRR

SEQ ID NO: 5089 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDSSGEPPSMTQLLRR

SEQ ID NO: 5090 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDSSSEPPSMTQLLRR

SEQ ID NO: 5091 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDSSAEPPSMTQLLRR

SEQ ID NO: 5092 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDSAGEPPSMTQLLRR

SEQ ID NO: 5093 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDSASEPPSMTQLLRR

SEQ ID NO: 5094 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDSAAEPPSMTQLLRR

SEQ ID NO: 5095 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDAGGEPPSMTQLLRR

SEQ ID NO: 5096 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDAGSEPPSMTQLLRR

SEQ ID NO: 5097 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDAGAEPPSMTQLLRR

SEQ ID NO: 5098 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDASGEPPSMTQLLRR

SEQ ID NO: 5099 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDASSEPPSMTQLLRR

SEQ ID NO: 5100 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDASAEPPSMTQLLRR

SEQ ID NO: 5101 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDAAGEPPSMTQLLRR

SEQ ID NO: 5102 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDAASEPPSMTQLLRR

SEQ ID NO: 5103 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKKGVSNKDIEKETAKDAAAEPPSMTQLLRR

SEQ ID NO: 5104 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDGGGEPPSMTQLLRR

SEQ ID NO: 5105 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDGGSEPPSMTQLLRR

SEQ ID NO: 5106 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDGGAEPPSMTQLLRR

SEQ ID NO: 5107 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDGSGEPPSMTQLLRR

SEQ ID NO: 5108 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDGSSEPPSMTQLLRR

SEQ ID NO: 5109 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDGSAEPPSMTQLLRR

SEQ ID NO: 5110 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDGAGEPPSMTQLLRR

SEQ ID NO: 5111 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDGASEPPSMTQLLRR

SEQ ID NO: 5112 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDGAAEPPSMTQLLRR

SEQ ID NO: 5113 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDSGGEPPSMTQLLRR

SEQ ID NO: 5114 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDSGSEPPSMTQLLRR

SEQ ID NO: 5115 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDSGAEPPSMTQLLRR

SEQ ID NO: 5116 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDSSGEPPSMTQLLRR

SEQ ID NO: 5117 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDSSSEPPSMTQLLRR

SEQ ID NO: 5118 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDSSAEPPSMTQLLRR

SEQ ID NO: 5119 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDSAGEPPSMTQLLRR

SEQ ID NO: 5120 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDSASEPPSMTQLLRR

SEQ ID NO: 5121 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDSAAEPPSMTQLLRR

SEQ ID NO: 5122 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDAGGEPPSMTQLLRR

SEQ ID NO: 5123 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDAGSEPPSMTQLLRR

SEQ ID NO: 5124 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDAGAEPPSMTQLLRR

SEQ ID NO: 5125 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDASGEPPSMTQLLRR

SEQ ID NO: 5126 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDASSEPPSMTQLLRR

SEQ ID NO: 5127 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDASAEPPSMTQLLRR

SEQ ID NO: 5128 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDAAGEPPSMTQLLRR

SEQ ID NO: 5129 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDAASEPPSMTQLLRR

SEQ ID NO: 5130 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKNGVSNKDIEKETAKDAAAEPPSMTQLLRR

SEQ ID NO: 5131 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDGGGEPPSMTQLLRR

SEQ ID NO: 5132 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDGGSEPPSMTQLLRR

SEQ ID NO: 5133 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDGGAEPPSMTQLLRR

SEQ ID NO: 5134 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDGSGEPPSMTQLLRR

SEQ ID NO: 5135 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDGSSEPPSMTQLLRR

SEQ ID NO: 5136 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDGSAEPPSMTQLLRR

SEQ ID NO: 5137 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDGAGEPPSMTQLLRR

SEQ ID NO: 5138 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDGASEPPSMTQLLRR

SEQ ID NO: 5139 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDGAAEPPSMTQLLRR

SEQ ID NO: 5140 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDSGGEPPSMTQLLRR

SEQ ID NO: 5141 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDSGSEPPSMTQLLRR

SEQ ID NO: 5142 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDSGAEPPSMTQLLRR

SEQ ID NO: 5143 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDSSGEPPSMTQLLRR

SEQ ID NO: 5144 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDSSSEPPSMTQLLRR

SEQ ID NO: 5145 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDSSAEPPSMTQLLRR

SEQ ID NO: 5146 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDSAGEPPSMTQLLRR

SEQ ID NO: 5147 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDSASEPPSMTQLLRR

SEQ ID NO: 5148 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDSAAEPPSMTQLLRR

SEQ ID NO: 5149 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDAGGEPPSMTQLLRR

SEQ ID NO: 5150 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDAGSEPPSMTQLLRR

SEQ ID NO: 5151 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDAGAEPPSMTQLLRR

SEQ ID NO: 5152 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDASGEPPSMTQLLRR

SEQ ID NO: 5153 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDASSEPPSMTQLLRR

SEQ ID NO: 5154 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDASAEPPSMTQLLRR

SEQ ID NO: 5155 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDAAGEPPSMTQLLRR

SEQ ID NO: 5156 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDAASEPPSMTQLLRR

SEQ ID NO: 5157 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDNFGLRGLLHLENASYGIEPLQNSSHFEHIIYRMDDVYKEPLKMGVSNKDIEKETAKDAAAEPPSMTQLLRR

SEQ ID NO: 5158 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDGGGEPPSMTQLLRR

SEQ ID NO: 5159 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDGGSEPPSMTQLLRR

SEQ ID NO: 5160 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDGGAEPPSMTQLLRR

SEQ ID NO: 5161 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDGSGEPPSMTQLLRR

SEQ ID NO: 5162 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDGSSEPPSMTQLLRR

SEQ ID NO: 5163 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDGSAEPPSMTQLLRR

SEQ ID NO: 5164 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDGAGEPPSMTQLLRR

SEQ ID NO: 5165 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDGASEPPSMTQLLRR

SEQ ID NO: 5166 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDGAAEPPSMTQLLRR

SEQ ID NO: 5167 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDSGGEPPSMTQLLRR

SEQ ID NO: 5168 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDSGSEPPSMTQLLRR

SEQ ID NO: 5169 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDSGAEPPSMTQLLRR

SEQ ID NO: 5170 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDSSGEPPSMTQLLRR

SEQ ID NO: 5171 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDSSSEPPSMTQLLRR

SEQ ID NO: 5172 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDSSAEPPSMTQLLRR

SEQ ID NO: 5173 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDSAGEPPSMTQLLRR

SEQ ID NO: 5174 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDSASEPPSMTQLLRR

SEQ ID NO: 5175 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDSAAEPPSMTQLLRR

SEQ ID NO: 5176 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDAGGEPPSMTQLLRR

SEQ ID NO: 5177 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDAGSEPPSMTQLLRR

SEQ ID NO: 5178 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDAGAEPPSMTQLLRR

SEQ ID NO: 5179 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDASGEPPSMTQLLRR

SEQ ID NO: 5180 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDASSEPPSMTQLLRR

SEQ ID NO: 5181 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDASAEPPSMTQLLRR

SEQ ID NO: 5182 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDAAGEPPSMTQLLRR

SEQ ID NO: 5183 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDAASEPPSMTQLLRR

SEQ ID NO: 5184 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKCGVSNKDIEKETAKDAAAEPPSMTQLLRR

SEQ ID NO: 5185 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDGGGEPPSMTQLLRR

SEQ ID NO: 5186 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDGGSEPPSMTQLLRR

SEQ ID NO: 5187 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDGGAEPPSMTQLLRR

SEQ ID NO: 5188 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDGSGEPPSMTQLLRR

SEQ ID NO: 5189 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDGSSEPPSMTQLLRR

SEQ ID NO: 5190 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDGSAEPPSMTQLLRR

SEQ ID NO: 5191 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDGAGEPPSMTQLLRR

SEQ ID NO: 5192 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDGASEPPSMTQLLRR

SEQ ID NO: 5193 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDGAAEPPSMTQLLRR

SEQ ID NO: 5194 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDSGGEPPSMTQLLRR

SEQ ID NO: 5195 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDSGSEPPSMTQLLRR

SEQ ID NO: 5196 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDSGAEPPSMTQLLRR

SEQ ID NO: 5197 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDSSGEPPSMTQLLRR

SEQ ID NO: 5198 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDSSSEPPSMTQLLRR

SEQ ID NO: 5199 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDSSAEPPSMTQLLRR

SEQ ID NO: 5200 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDSAGEPPSMTQLLRR

SEQ ID NO: 5201 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDSASEPPSMTQLLRR

SEQ ID NO: 5202 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDSAAEPPSMTQLLRR

SEQ ID NO: 5203 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDAGGEPPSMTQLLRR

SEQ ID NO: 5204 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDAGSEPPSMTQLLRR

SEQ ID NO: 5205 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDAGAEPPSMTQLLRR

SEQ ID NO: 5206 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDASGEPPSMTQLLRR

SEQ ID NO: 5207 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDASSEPPSMTQLLRR

SEQ ID NO: 5208 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDASAEPPSMTQLLRR

SEQ ID NO: 5209 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDAAGEPPSMTQLLRR

SEQ ID NO: 5210 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDAASEPPSMTQLLRR

SEQ ID NO: 5211 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKSGVSNKDIEKETAKDAAAEPPSMTQLLRR

SEQ ID NO: 5212 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDGGGEPPSMTQLLRR

SEQ ID NO: 5213 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDGGSEPPSMTQLLRR

SEQ ID NO: 5214 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDGGAEPPSMTQLLRR

SEQ ID NO: 5215 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDGSGEPPSMTQLLRR

SEQ ID NO: 5216 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDGSSEPPSMTQLLRR

SEQ ID NO: 5217 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDGSAEPPSMTQLLRR

SEQ ID NO: 5218 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDGAGEPPSMTQLLRR

SEQ ID NO: 5219 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDGASEPPSMTQLLRR

SEQ ID NO: 5220 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDGAAEPPSMTQLLRR

SEQ ID NO: 5221 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDSGGEPPSMTQLLRR

SEQ ID NO: 5222 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDSGSEPPSMTQLLRR

SEQ ID NO: 5223 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDSGAEPPSMTQLLRR

SEQ ID NO: 5224 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDSSGEPPSMTQLLRR

SEQ ID NO: 5225 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDSSSEPPSMTQLLRR

SEQ ID NO: 5226 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDSSAEPPSMTQLLRR

SEQ ID NO: 5227 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDSAGEPPSMTQLLRR

SEQ ID NO: 5228 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDSASEPPSMTQLLRR

SEQ ID NO: 5229 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDSAAEPPSMTQLLRR

SEQ ID NO: 5230 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDAGGEPPSMTQLLRR

SEQ ID NO: 5231 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDAGSEPPSMTQLLRR

SEQ ID NO: 5232 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDAGAEPPSMTQLLRR

SEQ ID NO: 5233 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDASGEPPSMTQLLRR

SEQ ID NO: 5234 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDASSEPPSMTQLLRR

SEQ ID NO: 5235 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDASAEPPSMTQLLRR

SEQ ID NO: 5236 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDAAGEPPSMTQLLRR

SEQ ID NO: 5237 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDAASEPPSMTQLLRR

SEQ ID NO: 5238 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKAGVSNKDIEKETAKDAAAEPPSMTQLLRR

SEQ ID NO: 5239 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDGGGEPPSMTQLLRR

SEQ ID NO: 5240 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDGGSEPPSMTQLLRR

SEQ ID NO: 5241 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDGGAEPPSMTQLLRR

SEQ ID NO: 5242 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDGSGEPPSMTQLLRR

SEQ ID NO: 5243 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDGSSEPPSMTQLLRR

SEQ ID NO: 5244 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDGSAEPPSMTQLLRR

SEQ ID NO: 5245 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDGAGEPPSMTQLLRR

SEQ ID NO: 5246 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDGASEPPSMTQLLRR

SEQ ID NO: 5247 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDGAAEPPSMTQLLRR

SEQ ID NO: 5248 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDSGGEPPSMTQLLRR

SEQ ID NO: 5249 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDSGSEPPSMTQLLRR

SEQ ID NO: 5250 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDSGAEPPSMTQLLRR

SEQ ID NO: 5251 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDSSGEPPSMTQLLRR

SEQ ID NO: 5252 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDSSSEPPSMTQLLRR

SEQ ID NO: 5253 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDSSAEPPSMTQLLRR

SEQ ID NO: 5254 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDSAGEPPSMTQLLRR

SEQ ID NO: 5255 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDSASEPPSMTQLLRR

SEQ ID NO: 5256 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDSAAEPPSMTQLLRR

SEQ ID NO: 5257 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDAGGEPPSMTQLLRR

SEQ ID NO: 5258 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDAGSEPPSMTQLLRR

SEQ ID NO: 5259 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDAGAEPPSMTQLLRR

SEQ ID NO: 5260 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDASGEPPSMTQLLRR

SEQ ID NO: 5261 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDASSEPPSMTQLLRR

SEQ ID NO: 5262 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDASAEPPSMTQLLRR

SEQ ID NO: 5263 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDAAGEPPSMTQLLRR

SEQ ID NO: 5264 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDAASEPPSMTQLLRR

SEQ ID NO: 5265 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKGGVSNKDIEKETAKDAAAEPPSMTQLLRR

SEQ ID NO: 5266 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDGGGEPPSMTQLLRR

SEQ ID NO: 5267 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDGGSEPPSMTQLLRR

SEQ ID NO: 5268 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDGGAEPPSMTQLLRR

SEQ ID NO: 5269 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDGSGEPPSMTQLLRR

SEQ ID NO: 5270 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDGSSEPPSMTQLLRR

SEQ ID NO: 5271 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDGSAEPPSMTQLLRR

SEQ ID NO: 5272 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDGAGEPPSMTQLLRR

SEQ ID NO: 5273 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDGASEPPSMTQLLRR

SEQ ID NO: 5274 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDGAAEPPSMTQLLRR

SEQ ID NO: 5275 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDSGGEPPSMTQLLRR

SEQ ID NO: 5276 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDSGSEPPSMTQLLRR

SEQ ID NO: 5277 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDSGAEPPSMTQLLRR

SEQ ID NO: 5278 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDSSGEPPSMTQLLRR

SEQ ID NO: 5279 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDSSSEPPSMTQLLRR

SEQ ID NO: 5280 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDSSAEPPSMTQLLRR

SEQ ID NO: 5281 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDSAGEPPSMTQLLRR

SEQ ID NO: 5282 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDSASEPPSMTQLLRR

SEQ ID NO: 5283 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDSAAEPPSMTQLLRR

SEQ ID NO: 5284 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDAGGEPPSMTQLLRR

SEQ ID NO: 5285 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDAGSEPPSMTQLLRR

SEQ ID NO: 5286 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDAGAEPPSMTQLLRR

SEQ ID NO: 5287 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDASGEPPSMTQLLRR

SEQ ID NO: 5288 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDASSEPPSMTQLLRR

SEQ ID NO: 5289 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDASAEPPSMTQLLRR

SEQ ID NO: 5290 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDAAGEPPSMTQLLRR

SEQ ID NO: 5291 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDAASEPPSMTQLLRR

SEQ ID NO: 5292 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKDGVSNKDIEKETAKDAAAEPPSMTQLLRR

SEQ ID NO: 5293 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDGGGEPPSMTQLLRR

SEQ ID NO: 5294 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDGGSEPPSMTQLLRR

SEQ ID NO: 5295 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDGGAEPPSMTQLLRR

SEQ ID NO: 5296 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDGSGEPPSMTQLLRR

SEQ ID NO: 5297 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDGSSEPPSMTQLLRR

SEQ ID NO: 5298 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDGSAEPPSMTQLLRR

SEQ ID NO: 5299 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDGAGEPPSMTQLLRR

SEQ ID NO: 5300 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDGASEPPSMTQLLRR

SEQ ID NO: 5301 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDGAAEPPSMTQLLRR

SEQ ID NO: 5302 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDSGGEPPSMTQLLRR

SEQ ID NO: 5303 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDSGSEPPSMTQLLRR

SEQ ID NO: 5304 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDSGAEPPSMTQLLRR

SEQ ID NO: 5305 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDSSGEPPSMTQLLRR

SEQ ID NO: 5306 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDSSSEPPSMTQLLRR

SEQ ID NO: 5307 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDSSAEPPSMTQLLRR

SEQ ID NO: 5308 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDSAGEPPSMTQLLRR

SEQ ID NO: 5309 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDSASEPPSMTQLLRR

SEQ ID NO: 5310 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDSAAEPPSMTQLLRR

SEQ ID NO: 5311 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDAGGEPPSMTQLLRR

SEQ ID NO: 5312 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDAGSEPPSMTQLLRR

SEQ ID NO: 5313 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDAGAEPPSMTQLLRR

SEQ ID NO: 5314 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDASGEPPSMTQLLRR

SEQ ID NO: 5315 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDASSEPPSMTQLLRR

SEQ ID NO: 5316 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDASAEPPSMTQLLRR

SEQ ID NO: 5317 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDAAGEPPSMTQLLRR

SEQ ID NO: 5318 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDAASEPPSMTQLLRR

SEQ ID NO: 5319 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKHGVSNKDIEKETAKDAAAEPPSMTQLLRR

SEQ ID NO: 5320 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDGGGEPPSMTQLLRR

SEQ ID NO: 5321 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDGGSEPPSMTQLLRR

SEQ ID NO: 5322 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDGGAEPPSMTQLLRR

SEQ ID NO: 5323 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDGSGEPPSMTQLLRR

SEQ ID NO: 5324 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDGSSEPPSMTQLLRR

SEQ ID NO: 5325 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDGSAEPPSMTQLLRR

SEQ ID NO: 5326 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDGAGEPPSMTQLLRR

SEQ ID NO: 5327 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDGASEPPSMTQLLRR

SEQ ID NO: 5328 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDGAAEPPSMTQLLRR

SEQ ID NO: 5329 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDSGGEPPSMTQLLRR

SEQ ID NO: 5330 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDSGSEPPSMTQLLRR

SEQ ID NO: 5331 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDSGAEPPSMTQLLRR

SEQ ID NO: 5332 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDSSGEPPSMTQLLRR

SEQ ID NO: 5333 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDSSSEPPSMTQLLRR

SEQ ID NO: 5334 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDSSAEPPSMTQLLRR

SEQ ID NO: 5335 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDSAGEPPSMTQLLRR

SEQ ID NO: 5336 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDSASEPPSMTQLLRR

SEQ ID NO: 5337 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDSAAEPPSMTQLLRR

SEQ ID NO: 5338 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDAGGEPPSMTQLLRR

SEQ ID NO: 5339 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDAGSEPPSMTQLLRR

SEQ ID NO: 5340 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDAGAEPPSMTQLLRR

SEQ ID NO: 5341 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDASGEPPSMTQLLRR

SEQ ID NO: 5342 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDASSEPPSMTQLLRR

SEQ ID NO: 5343 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDASAEPPSMTQLLRR

SEQ ID NO: 5344 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDAAGEPPSMTQLLRR

SEQ ID NO: 5345 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDAASEPPSMTQLLRR

SEQ ID NO: 5346 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKYGVSNKDIEKETAKDAAAEPPSMTQLLRR

SEQ ID NO: 5347 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDGGGEPPSMTQLLRR

SEQ ID NO: 5348 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDGGSEPPSMTQLLRR

SEQ ID NO: 5349 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDGGAEPPSMTQLLRR

SEQ ID NO: 5350 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDGSGEPPSMTQLLRR

SEQ ID NO: 5351 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDGSSEPPSMTQLLRR

SEQ ID NO: 5352 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDGSAEPPSMTQLLRR

SEQ ID NO: 5353 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDGAGEPPSMTQLLRR

SEQ ID NO: 5354 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDGASEPPSMTQLLRR

SEQ ID NO: 5355 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDGAAEPPSMTQLLRR

SEQ ID NO: 5356 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDSGGEPPSMTQLLRR

SEQ ID NO: 5357 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDSGSEPPSMTQLLRR

SEQ ID NO: 5358 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDSGAEPPSMTQLLRR

SEQ ID NO: 5359 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDSSGEPPSMTQLLRR

SEQ ID NO: 5360 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDSSSEPPSMTQLLRR

SEQ ID NO: 5361 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDSSAEPPSMTQLLRR

SEQ ID NO: 5362 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDSAGEPPSMTQLLRR

SEQ ID NO: 5363 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDSASEPPSMTQLLRR

SEQ ID NO: 5364 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDSAAEPPSMTQLLRR

SEQ ID NO: 5365 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDAGGEPPSMTQLLRR

SEQ ID NO: 5366 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDAGSEPPSMTQLLRR

SEQ ID NO: 5367 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDAGAEPPSMTQLLRR

SEQ ID NO: 5368 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDASGEPPSMTQLLRR

SEQ ID NO: 5369 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDASSEPPSMTQLLRR

SEQ ID NO: 5370 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDASAEPPSMTQLLRR

SEQ ID NO: 5371 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDAAGEPPSMTQLLRR

SEQ ID NO: 5372 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDAASEPPSMTQLLRR

SEQ ID NO: 5373 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKKGVSNKDIEKETAKDAAAEPPSMTQLLRR

SEQ ID NO: 5374 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDGGGEPPSMTQLLRR

SEQ ID NO: 5375 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDGGSEPPSMTQLLRR

SEQ ID NO: 5376 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDGGAEPPSMTQLLRR

SEQ ID NO: 5377 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDGSGEPPSMTQLLRR

SEQ ID NO: 5378 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDGSSEPPSMTQLLRR

SEQ ID NO: 5379 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDGSAEPPSMTQLLRR

SEQ ID NO: 5380 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDGAGEPPSMTQLLRR

SEQ ID NO: 5381 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDGASEPPSMTQLLRR

SEQ ID NO: 5382 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDGAAEPPSMTQLLRR

SEQ ID NO: 5383 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDSGGEPPSMTQLLRR

SEQ ID NO: 5384 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDSGSEPPSMTQLLRR

SEQ ID NO: 5385 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDSGAEPPSMTQLLRR

SEQ ID NO: 5386 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDSSGEPPSMTQLLRR

SEQ ID NO: 5387 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDSSSEPPSMTQLLRR

SEQ ID NO: 5388 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDSSAEPPSMTQLLRR

SEQ ID NO: 5389 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDSAGEPPSMTQLLRR

SEQ ID NO: 5390 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDSASEPPSMTQLLRR

SEQ ID NO: 5391 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDSAAEPPSMTQLLRR

SEQ ID NO: 5392 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDAGGEPPSMTQLLRR

SEQ ID NO: 5393 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDAGSEPPSMTQLLRR

SEQ ID NO: 5394 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDAGAEPPSMTQLLRR

SEQ ID NO: 5395 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDASGEPPSMTQLLRR

SEQ ID NO: 5396 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDASSEPPSMTQLLRR

SEQ ID NO: 5397 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDASAEPPSMTQLLRR

SEQ ID NO: 5398 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDAAGEPPSMTQLLRR

SEQ ID NO: 5399 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDAASEPPSMTQLLRR

SEQ ID NO: 5400 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKNGVSNKDIEKETAKDAAAEPPSMTQLLRR

SEQ ID NO: 5401 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDGGGEPPSMTQLLRR

SEQ ID NO: 5402 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDGGSEPPSMTQLLRR

SEQ ID NO: 5403 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDGGAEPPSMTQLLRR

SEQ ID NO: 5404 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDGSGEPPSMTQLLRR

SEQ ID NO: 5405 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDGSSEPPSMTQLLRR

SEQ ID NO: 5406 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDGSAEPPSMTQLLRR

SEQ ID NO: 5407 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDGAGEPPSMTQLLRR

SEQ ID NO: 5408 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDGASEPPSMTQLLRR

SEQ ID NO: 5409 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDGAAEPPSMTQLLRR

SEQ ID NO: 5410 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDSGGEPPSMTQLLRR

SEQ ID NO: 5411 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDSGSEPPSMTQLLRR

SEQ ID NO: 5412 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDSGAEPPSMTQLLRR

SEQ ID NO: 5413 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDSSGEPPSMTQLLRR

SEQ ID NO: 5414 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDSSSEPPSMTQLLRR

SEQ ID NO: 5415 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDSSAEPPSMTQLLRR

SEQ ID NO: 5416 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDSAGEPPSMTQLLRR

SEQ ID NO: 5417 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDSASEPPSMTQLLRR

SEQ ID NO: 5418 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDSAAEPPSMTQLLRR

SEQ ID NO: 5419 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDAGGEPPSMTQLLRR

SEQ ID NO: 5420 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDAGSEPPSMTQLLRR

SEQ ID NO: 5421 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDAGAEPPSMTQLLRR

SEQ ID NO: 5422 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDASGEPPSMTQLLRR

SEQ ID NO: 5423 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDASSEPPSMTQLLRR

SEQ ID NO: 5424 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDASAEPPSMTQLLRR

SEQ ID NO: 5425 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDAAGEPPSMTQLLRR

SEQ ID NO: 5426 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDAASEPPSMTQLLRR

SEQ ID NO: 5427 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHSHYRGYVEGVHNSSIALSDMFGLRGLLHLENASYGIEPLQNSSHFEHIIYRMDDVYKEPLKMGVSNKDIEKETAKDAAAEPPSMTQLLRR

SEQ ID NO: 5428 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDGGGEPPSMTQLLRR

SEQ ID NO: 5429 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDGGSEPPSMTQLLRR

SEQ ID NO: 5430 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDGGAEPPSMTQLLRR

SEQ ID NO: 5431 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDGSGEPPSMTQLLRR

SEQ ID NO: 5432 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDGSSEPPSMTQLLRR

SEQ ID NO: 5433 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDGSAEPPSMTQLLRR

SEQ ID NO: 5434 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDGAGEPPSMTQLLRR

SEQ ID NO: 5435 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDGASEPPSMTQLLRR

SEQ ID NO: 5436 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDGAAEPPSMTQLLRR

SEQ ID NO: 5437 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDSGGEPPSMTQLLRR

SEQ ID NO: 5438 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDSGSEPPSMTQLLRR

SEQ ID NO: 5439 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDSGAEPPSMTQLLRR

SEQ ID NO: 5440 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDSSGEPPSMTQLLRR

SEQ ID NO: 5441 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDSSSEPPSMTQLLRR

SEQ ID NO: 5442 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDSSAEPPSMTQLLRR

SEQ ID NO: 5443 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDSAGEPPSMTQLLRR

SEQ ID NO: 5444 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDSASEPPSMTQLLRR

SEQ ID NO: 5445 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDSAAEPPSMTQLLRR

SEQ ID NO: 5446 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDAGGEPPSMTQLLRR

SEQ ID NO: 5447 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDAGSEPPSMTQLLRR

SEQ ID NO: 5448 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDAGAEPPSMTQLLRR

SEQ ID NO: 5449 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDASGEPPSMTQLLRR

SEQ ID NO: 5450 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDASSEPPSMTQLLRR

SEQ ID NO: 5451 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDASAEPPSMTQLLRR

SEQ ID NO: 5452 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDAAGEPPSMTQLLRR

SEQ ID NO: 5453 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDAASEPPSMTQLLRR

SEQ ID NO: 5454 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKCGVSNKDIEKETAKDAAAEPPSMTQLLRR

SEQ ID NO: 5455 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDGGGEPPSMTQLLRR

SEQ ID NO: 5456 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDGGSEPPSMTQLLRR

SEQ ID NO: 5457 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDGGAEPPSMTQLLRR

SEQ ID NO: 5458 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDGSGEPPSMTQLLRR

SEQ ID NO: 5459 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDGSSEPPSMTQLLRR

SEQ ID NO: 5460 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDGSAEPPSMTQLLRR

SEQ ID NO: 5461 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDGAGEPPSMTQLLRR

SEQ ID NO: 5462 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDGASEPPSMTQLLRR

SEQ ID NO: 5463 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDGAAEPPSMTQLLRR

SEQ ID NO: 5464 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDSGGEPPSMTQLLRR

SEQ ID NO: 5465 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDSGSEPPSMTQLLRR

SEQ ID NO: 5466 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDSGAEPPSMTQLLRR

SEQ ID NO: 5467 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDSSGEPPSMTQLLRR

SEQ ID NO: 5468 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDSSSEPPSMTQLLRR

SEQ ID NO: 5469 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDSSAEPPSMTQLLRR

SEQ ID NO: 5470 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDSAGEPPSMTQLLRR

SEQ ID NO: 5471 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDSASEPPSMTQLLRR

SEQ ID NO: 5472 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDSAAEPPSMTQLLRR

SEQ ID NO: 5473 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDAGGEPPSMTQLLRR

SEQ ID NO: 5474 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDAGSEPPSMTQLLRR

SEQ ID NO: 5475 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDAGAEPPSMTQLLRR

SEQ ID NO: 5476 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDASGEPPSMTQLLRR

SEQ ID NO: 5477 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDASSEPPSMTQLLRR

SEQ ID NO: 5478 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDASAEPPSMTQLLRR

SEQ ID NO: 5479 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDAAGEPPSMTQLLRR

SEQ ID NO: 5480 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDAASEPPSMTQLLRR

SEQ ID NO: 5481 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKSGVSNKDIEKETAKDAAAEPPSMTQLLRR

SEQ ID NO: 5482 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDGGGEPPSMTQLLRR

SEQ ID NO: 5483 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDGGSEPPSMTQLLRR

SEQ ID NO: 5484 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDGGAEPPSMTQLLRR

SEQ ID NO: 5485 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDGSGEPPSMTQLLRR

SEQ ID NO: 5486 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDGSSEPPSMTQLLRR

SEQ ID NO: 5487 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDGSAEPPSMTQLLRR

SEQ ID NO: 5488 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDGAGEPPSMTQLLRR

SEQ ID NO: 5489 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDGASEPPSMTQLLRR

SEQ ID NO: 5490 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDGAAEPPSMTQLLRR

SEQ ID NO: 5491 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDSGGEPPSMTQLLRR

SEQ ID NO: 5492 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDSGSEPPSMTQLLRR

SEQ ID NO: 5493 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDSGAEPPSMTQLLRR

SEQ ID NO: 5494 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDSSGEPPSMTQLLRR

SEQ ID NO: 5495 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDSSSEPPSMTQLLRR

SEQ ID NO: 5496 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDSSAEPPSMTQLLRR

SEQ ID NO: 5497 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDSAGEPPSMTQLLRR

SEQ ID NO: 5498 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDSASEPPSMTQLLRR

SEQ ID NO: 5499 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDSAAEPPSMTQLLRR

SEQ ID NO: 5500 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDAGGEPPSMTQLLRR

SEQ ID NO: 5501 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDAGSEPPSMTQLLRR

SEQ ID NO: 5502 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDAGAEPPSMTQLLRR

SEQ ID NO: 5503 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDASGEPPSMTQLLRR

SEQ ID NO: 5504 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDASSEPPSMTQLLRR

SEQ ID NO: 5505 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDASAEPPSMTQLLRR

SEQ ID NO: 5506 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDAAGEPPSMTQLLRR

SEQ ID NO: 5507 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDAASEPPSMTQLLRR

SEQ ID NO: 5508 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKAGVSNKDIEKETAKDAAAEPPSMTQLLRR

SEQ ID NO: 5509 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDGGGEPPSMTQLLRR

SEQ ID NO: 5510 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDGGSEPPSMTQLLRR

SEQ ID NO: 5511 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDGGAEPPSMTQLLRR

SEQ ID NO: 5512 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDGSGEPPSMTQLLRR

SEQ ID NO: 5513 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDGSSEPPSMTQLLRR

SEQ ID NO: 5514 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDGSAEPPSMTQLLRR

SEQ ID NO: 5515 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDGAGEPPSMTQLLRR

SEQ ID NO: 5516 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDGASEPPSMTQLLRR

SEQ ID NO: 5517 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDGAAEPPSMTQLLRR

SEQ ID NO: 5518 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDSGGEPPSMTQLLRR

SEQ ID NO: 5519 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDSGSEPPSMTQLLRR

SEQ ID NO: 5520 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDSGAEPPSMTQLLRR

SEQ ID NO: 5521 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDSSGEPPSMTQLLRR

SEQ ID NO: 5522 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDSSSEPPSMTQLLRR

SEQ ID NO: 5523 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDSSAEPPSMTQLLRR

SEQ ID NO: 5524 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDSAGEPPSMTQLLRR

SEQ ID NO: 5525 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDSASEPPSMTQLLRR

SEQ ID NO: 5526 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDSAAEPPSMTQLLRR

SEQ ID NO: 5527 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDAGGEPPSMTQLLRR

SEQ ID NO: 5528 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDAGSEPPSMTQLLRR

SEQ ID NO: 5529 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDAGAEPPSMTQLLRR

SEQ ID NO: 5530 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDASGEPPSMTQLLRR

SEQ ID NO: 5531 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDASSEPPSMTQLLRR

SEQ ID NO: 5532 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDASAEPPSMTQLLRR

SEQ ID NO: 5533 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDAAGEPPSMTQLLRR

SEQ ID NO: 5534 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDAASEPPSMTQLLRR

SEQ ID NO: 5535 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKGGVSNKDIEKETAKDAAAEPPSMTQLLRR

SEQ ID NO: 5536 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDGGGEPPSMTQLLRR

SEQ ID NO: 5537 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDGGSEPPSMTQLLRR

SEQ ID NO: 5538 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDGGAEPPSMTQLLRR

SEQ ID NO: 5539 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDGSGEPPSMTQLLRR

SEQ ID NO: 5540 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDGSSEPPSMTQLLRR

SEQ ID NO: 5541 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDGSAEPPSMTQLLRR

SEQ ID NO: 5542 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDGAGEPPSMTQLLRR

SEQ ID NO: 5543 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDGASEPPSMTQLLRR

SEQ ID NO: 5544 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDGAAEPPSMTQLLRR

SEQ ID NO: 5545 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDSGGEPPSMTQLLRR

SEQ ID NO: 5546 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDSGSEPPSMTQLLRR

SEQ ID NO: 5547 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDSGAEPPSMTQLLRR

SEQ ID NO: 5548 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDSSGEPPSMTQLLRR

SEQ ID NO: 5549 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDSSSEPPSMTQLLRR

SEQ ID NO: 5550 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDSSAEPPSMTQLLRR

SEQ ID NO: 5551 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDSAGEPPSMTQLLRR

SEQ ID NO: 5552 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDSASEPPSMTQLLRR

SEQ ID NO: 5553 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDSAAEPPSMTQLLRR

SEQ ID NO: 5554 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDAGGEPPSMTQLLRR

SEQ ID NO: 5555 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDAGSEPPSMTQLLRR

SEQ ID NO: 5556 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDAGAEPPSMTQLLRR

SEQ ID NO: 5557 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDASGEPPSMTQLLRR

SEQ ID NO: 5558 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDASSEPPSMTQLLRR

SEQ ID NO: 5559 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDASAEPPSMTQLLRR

SEQ ID NO: 5560 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDAAGEPPSMTQLLRR

SEQ ID NO: 5561 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDAASEPPSMTQLLRR

SEQ ID NO: 5562 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKDGVSNKDIEKETAKDAAAEPPSMTQLLRR

SEQ ID NO: 5563 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDGGGEPPSMTQLLRR

SEQ ID NO: 5564 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDGGSEPPSMTQLLRR

SEQ ID NO: 5565 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDGGAEPPSMTQLLRR

SEQ ID NO: 5566 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDGSGEPPSMTQLLRR

SEQ ID NO: 5567 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDGSSEPPSMTQLLRR

SEQ ID NO: 5568 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDGSAEPPSMTQLLRR

SEQ ID NO: 5569 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDGAGEPPSMTQLLRR

SEQ ID NO: 5570 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDGASEPPSMTQLLRR

SEQ ID NO: 5571 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDGAAEPPSMTQLLRR

SEQ ID NO: 5572 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDSGGEPPSMTQLLRR

SEQ ID NO: 5573 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDSGSEPPSMTQLLRR

SEQ ID NO: 5574 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDSGAEPPSMTQLLRR

SEQ ID NO: 5575 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDSSGEPPSMTQLLRR

SEQ ID NO: 5576 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDSSSEPPSMTQLLRR

SEQ ID NO: 5577 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDSSAEPPSMTQLLRR

SEQ ID NO: 5578 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDSAGEPPSMTQLLRR

SEQ ID NO: 5579 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDSASEPPSMTQLLRR

SEQ ID NO: 5580 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDSAAEPPSMTQLLRR

SEQ ID NO: 5581 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDAGGEPPSMTQLLRR

SEQ ID NO: 5582 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDAGSEPPSMTQLLRR

SEQ ID NO: 5583 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDAGAEPPSMTQLLRR

SEQ ID NO: 5584 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDASGEPPSMTQLLRR

SEQ ID NO: 5585 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDASSEPPSMTQLLRR

SEQ ID NO: 5586 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDASAEPPSMTQLLRR

SEQ ID NO: 5587 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDAAGEPPSMTQLLRR

SEQ ID NO: 5588 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDAASEPPSMTQLLRR

SEQ ID NO: 5589 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKHGVSNKDIEKETAKDAAAEPPSMTQLLRR

SEQ ID NO: 5590 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDGGGEPPSMTQLLRR

SEQ ID NO: 5591 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDGGSEPPSMTQLLRR

SEQ ID NO: 5592 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDGGAEPPSMTQLLRR

SEQ ID NO: 5593 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDGSGEPPSMTQLLRR

SEQ ID NO: 5594 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDGSSEPPSMTQLLRR

SEQ ID NO: 5595 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDGSAEPPSMTQLLRR

SEQ ID NO: 5596 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDGAGEPPSMTQLLRR

SEQ ID NO: 5597 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDGASEPPSMTQLLRR

SEQ ID NO: 5598 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDGAAEPPSMTQLLRR

SEQ ID NO: 5599 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDSGGEPPSMTQLLRR

SEQ ID NO: 5600 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDSGSEPPSMTQLLRR

SEQ ID NO: 5601 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDSGAEPPSMTQLLRR

SEQ ID NO: 5602 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDSSGEPPSMTQLLRR

SEQ ID NO: 5603 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDSSSEPPSMTQLLRR

SEQ ID NO: 5604 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDSSAEPPSMTQLLRR

SEQ ID NO: 5605 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDSAGEPPSMTQLLRR

SEQ ID NO: 5606 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDSASEPPSMTQLLRR

SEQ ID NO: 5607 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDSAAEPPSMTQLLRR

SEQ ID NO: 5608 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDAGGEPPSMTQLLRR

SEQ ID NO: 5609 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDAGSEPPSMTQLLRR

SEQ ID NO: 5610 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDAGAEPPSMTQLLRR

SEQ ID NO: 5611 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDASGEPPSMTQLLRR

SEQ ID NO: 5612 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDASSEPPSMTQLLRR

SEQ ID NO: 5613 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDASAEPPSMTQLLRR

SEQ ID NO: 5614 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDAAGEPPSMTQLLRR

SEQ ID NO: 5615 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDAASEPPSMTQLLRR

SEQ ID NO: 5616 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKYGVSNKDIEKETAKDAAAEPPSMTQLLRR

SEQ ID NO: 5617 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDGGGEPPSMTQLLRR

SEQ ID NO: 5618 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDGGSEPPSMTQLLRR

SEQ ID NO: 5619 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDGGAEPPSMTQLLRR

SEQ ID NO: 5620 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDGSGEPPSMTQLLRR

SEQ ID NO: 5621 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDGSSEPPSMTQLLRR

SEQ ID NO: 5622 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDGSAEPPSMTQLLRR

SEQ ID NO: 5623 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDGAGEPPSMTQLLRR

SEQ ID NO: 5624 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDGASEPPSMTQLLRR

SEQ ID NO: 5625 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDGAAEPPSMTQLLRR

SEQ ID NO: 5626 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDSGGEPPSMTQLLRR

SEQ ID NO: 5627 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDSGSEPPSMTQLLRR

SEQ ID NO: 5628 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDSGAEPPSMTQLLRR

SEQ ID NO: 5629 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDSSGEPPSMTQLLRR

SEQ ID NO: 5630 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDSSSEPPSMTQLLRR

SEQ ID NO: 5631 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDSSAEPPSMTQLLRR

SEQ ID NO: 5632 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDSAGEPPSMTQLLRR

SEQ ID NO: 5633 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDSASEPPSMTQLLRR

SEQ ID NO: 5634 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDSAAEPPSMTQLLRR

SEQ ID NO: 5635 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDAGGEPPSMTQLLRR

SEQ ID NO: 5636 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDAGSEPPSMTQLLRR

SEQ ID NO: 5637 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDAGAEPPSMTQLLRR

SEQ ID NO: 5638 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDASGEPPSMTQLLRR

SEQ ID NO: 5639 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDASSEPPSMTQLLRR

SEQ ID NO: 5640 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDASAEPPSMTQLLRR

SEQ ID NO: 5641 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDAAGEPPSMTQLLRR

SEQ ID NO: 5642 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDAASEPPSMTQLLRR

SEQ ID NO: 5643 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKKGVSNKDIEKETAKDAAAEPPSMTQLLRR

SEQ ID NO: 5644 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDGGGEPPSMTQLLRR

SEQ ID NO: 5645 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDGGSEPPSMTQLLRR

SEQ ID NO: 5646 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDGGAEPPSMTQLLRR

SEQ ID NO: 5647 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDGSGEPPSMTQLLRR

SEQ ID NO: 5648 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDGSSEPPSMTQLLRR

SEQ ID NO: 5649 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDGSAEPPSMTQLLRR

SEQ ID NO: 5650 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDGAGEPPSMTQLLRR

SEQ ID NO: 5651 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDGASEPPSMTQLLRR

SEQ ID NO: 5652 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDGAAEPPSMTQLLRR

SEQ ID NO: 5653 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDSGGEPPSMTQLLRR

SEQ ID NO: 5654 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDSGSEPPSMTQLLRR

SEQ ID NO: 5655 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDSGAEPPSMTQLLRR

SEQ ID NO: 5656 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDSSGEPPSMTQLLRR

SEQ ID NO: 5657 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDSSSEPPSMTQLLRR

SEQ ID NO: 5658 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDSSAEPPSMTQLLRR

SEQ ID NO: 5659 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDSAGEPPSMTQLLRR

SEQ ID NO: 5660 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDSASEPPSMTQLLRR

SEQ ID NO: 5661 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDSAAEPPSMTQLLRR

SEQ ID NO: 5662 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDAGGEPPSMTQLLRR

SEQ ID NO: 5663 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDAGSEPPSMTQLLRR

SEQ ID NO: 5664 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDAGAEPPSMTQLLRR

SEQ ID NO: 5665 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDASGEPPSMTQLLRR

SEQ ID NO: 5666 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDASSEPPSMTQLLRR

SEQ ID NO: 5667 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDASAEPPSMTQLLRR

SEQ ID NO: 5668 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDAAGEPPSMTQLLRR

SEQ ID NO: 5669 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDAASEPPSMTQLLRR

SEQ ID NO: 5670 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKNGVSNKDIEKETAKDAAAEPPSMTQLLRR

SEQ ID NO: 5671 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDGGGEPPSMTQLLRR

SEQ ID NO: 5672 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDGGSEPPSMTQLLRR

SEQ ID NO: 5673 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDGGAEPPSMTQLLRR

SEQ ID NO: 5674 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDGSGEPPSMTQLLRR

SEQ ID NO: 5675 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDGSSEPPSMTQLLRR

SEQ ID NO: 5676 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDGSAEPPSMTQLLRR

SEQ ID NO: 5677 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDGAGEPPSMTQLLRR

SEQ ID NO: 5678 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDGASEPPSMTQLLRR

SEQ ID NO: 5679 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDGAAEPPSMTQLLRR

SEQ ID NO: 5680 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDSGGEPPSMTQLLRR

SEQ ID NO: 5681 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDSGSEPPSMTQLLRR

SEQ ID NO: 5682 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDSGAEPPSMTQLLRR

SEQ ID NO: 5683 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDSSGEPPSMTQLLRR

SEQ ID NO: 5684 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDSSSEPPSMTQLLRR

SEQ ID NO: 5685 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDSSAEPPSMTQLLRR

SEQ ID NO: 5686 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDSAGEPPSMTQLLRR

SEQ ID NO: 5687 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDSASEPPSMTQLLRR

SEQ ID NO: 5688 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDSAAEPPSMTQLLRR

SEQ ID NO: 5689 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDAGGEPPSMTQLLRR

SEQ ID NO: 5690 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDAGSEPPSMTQLLRR

SEQ ID NO: 5691 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDAGAEPPSMTQLLRR

SEQ ID NO: 5692 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDASGEPPSMTQLLRR

SEQ ID NO: 5693 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDASSEPPSMTQLLRR

SEQ ID NO: 5694 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDASAEPPSMTQLLRR

SEQ ID NO: 5695 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDAAGEPPSMTQLLRR

SEQ ID NO: 5696 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDAASEPPSMTQLLRR

SEQ ID NO: 5697 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDCFGLRGLLHLENASYGIEPLQNSSHFEHIIYRMDDVYKEPLKMGVSNKDIEKETAKDAAAEPPSMTQLLRR

SEQ ID NO: 5698 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDGGGEPPSMTQLLRR

SEQ ID NO: 5699 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDGGSEPPSMTQLLRR

SEQ ID NO: 5700 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDGGAEPPSMTQLLRR

SEQ ID NO: 5701 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDGSGEPPSMTQLLRR

SEQ ID NO: 5702 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDGSSEPPSMTQLLRR

SEQ ID NO: 5703 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDGSAEPPSMTQLLRR

SEQ ID NO: 5704 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDGAGEPPSMTQLLRR

SEQ ID NO: 5705 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDGASEPPSMTQLLRR

SEQ ID NO: 5706 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDGAAEPPSMTQLLRR

SEQ ID NO: 5707 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDSGGEPPSMTQLLRR

SEQ ID NO: 5708 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDSGSEPPSMTQLLRR

SEQ ID NO: 5709 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDSGAEPPSMTQLLRR

SEQ ID NO: 5710 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDSSGEPPSMTQLLRR

SEQ ID NO: 5711 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDSSSEPPSMTQLLRR

SEQ ID NO: 5712 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDSSAEPPSMTQLLRR

SEQ ID NO: 5713 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDSAGEPPSMTQLLRR

SEQ ID NO: 5714 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDSASEPPSMTQLLRR

SEQ ID NO: 5715 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDSAAEPPSMTQLLRR

SEQ ID NO: 5716 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDAGGEPPSMTQLLRR

SEQ ID NO: 5717 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDAGSEPPSMTQLLRR

SEQ ID NO: 5718 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDAGAEPPSMTQLLRR

SEQ ID NO: 5719 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDASGEPPSMTQLLRR

SEQ ID NO: 5720 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDASSEPPSMTQLLRR

SEQ ID NO: 5721 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDASAEPPSMTQLLRR

SEQ ID NO: 5722 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDAAGEPPSMTQLLRR

SEQ ID NO: 5723 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDAASEPPSMTQLLRR

SEQ ID NO: 5724 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKCGVSNKDIEKETAKDAAAEPPSMTQLLRR

SEQ ID NO: 5725 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDGGGEPPSMTQLLRR

SEQ ID NO: 5726 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDGGSEPPSMTQLLRR

SEQ ID NO: 5727 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDGGAEPPSMTQLLRR

SEQ ID NO: 5728 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDGSGEPPSMTQLLRR

SEQ ID NO: 5729 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDGSSEPPSMTQLLRR

SEQ ID NO: 5730 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDGSAEPPSMTQLLRR

SEQ ID NO: 5731 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDGAGEPPSMTQLLRR

SEQ ID NO: 5732 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDGASEPPSMTQLLRR

SEQ ID NO: 5733 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDGAAEPPSMTQLLRR

SEQ ID NO: 5734 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDSGGEPPSMTQLLRR

SEQ ID NO: 5735 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDSGSEPPSMTQLLRR

SEQ ID NO: 5736 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDSGAEPPSMTQLLRR

SEQ ID NO: 5737 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDSSGEPPSMTQLLRR

SEQ ID NO: 5738 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDSSSEPPSMTQLLRR

SEQ ID NO: 5739 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDSSAEPPSMTQLLRR

SEQ ID NO: 5740 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDSAGEPPSMTQLLRR

SEQ ID NO: 5741 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDSASEPPSMTQLLRR

SEQ ID NO: 5742 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDSAAEPPSMTQLLRR

SEQ ID NO: 5743 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDAGGEPPSMTQLLRR

SEQ ID NO: 5744 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDAGSEPPSMTQLLRR

SEQ ID NO: 5745 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDAGAEPPSMTQLLRR

SEQ ID NO: 5746 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDASGEPPSMTQLLRR

SEQ ID NO: 5747 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDASSEPPSMTQLLRR

SEQ ID NO: 5748 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDASAEPPSMTQLLRR

SEQ ID NO: 5749 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDAAGEPPSMTQLLRR

SEQ ID NO: 5750 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDAASEPPSMTQLLRR

SEQ ID NO: 5751 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKSGVSNKDIEKETAKDAAAEPPSMTQLLRR

SEQ ID NO: 5752 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDGGGEPPSMTQLLRR

SEQ ID NO: 5753 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDGGSEPPSMTQLLRR

SEQ ID NO: 5754 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDGGAEPPSMTQLLRR

SEQ ID NO: 5755 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDGSGEPPSMTQLLRR

SEQ ID NO: 5756 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDGSSEPPSMTQLLRR

SEQ ID NO: 5757 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDGSAEPPSMTQLLRR

SEQ ID NO: 5758 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDGAGEPPSMTQLLRR

SEQ ID NO: 5759 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDGASEPPSMTQLLRR

SEQ ID NO: 5760 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDGAAEPPSMTQLLRR

SEQ ID NO: 5761 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDSGGEPPSMTQLLRR

SEQ ID NO: 5762 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDSGSEPPSMTQLLRR

SEQ ID NO: 5763 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDSGAEPPSMTQLLRR

SEQ ID NO: 5764 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDSSGEPPSMTQLLRR

SEQ ID NO: 5765 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDSSSEPPSMTQLLRR

SEQ ID NO: 5766 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDSSAEPPSMTQLLRR

SEQ ID NO: 5767 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDSAGEPPSMTQLLRR

SEQ ID NO: 5768 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDSASEPPSMTQLLRR

SEQ ID NO: 5769 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDSAAEPPSMTQLLRR

SEQ ID NO: 5770 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDAGGEPPSMTQLLRR

SEQ ID NO: 5771 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDAGSEPPSMTQLLRR

SEQ ID NO: 5772 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDAGAEPPSMTQLLRR

SEQ ID NO: 5773 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDASGEPPSMTQLLRR

SEQ ID NO: 5774 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDASSEPPSMTQLLRR

SEQ ID NO: 5775 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDASAEPPSMTQLLRR

SEQ ID NO: 5776 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDAAGEPPSMTQLLRR

SEQ ID NO: 5777 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDAASEPPSMTQLLRR

SEQ ID NO: 5778 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKAGVSNKDIEKETAKDAAAEPPSMTQLLRR

SEQ ID NO: 5779 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDGGGEPPSMTQLLRR

SEQ ID NO: 5780 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDGGSEPPSMTQLLRR

SEQ ID NO: 5781 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDGGAEPPSMTQLLRR

SEQ ID NO: 5782 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDGSGEPPSMTQLLRR

SEQ ID NO: 5783 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDGSSEPPSMTQLLRR

SEQ ID NO: 5784 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDGSAEPPSMTQLLRR

SEQ ID NO: 5785 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDGAGEPPSMTQLLRR

SEQ ID NO: 5786 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDGASEPPSMTQLLRR

SEQ ID NO: 5787 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDGAAEPPSMTQLLRR

SEQ ID NO: 5788 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDSGGEPPSMTQLLRR

SEQ ID NO: 5789 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDSGSEPPSMTQLLRR

SEQ ID NO: 5790 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDSGAEPPSMTQLLRR

SEQ ID NO: 5791 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDSSGEPPSMTQLLRR

SEQ ID NO: 5792 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDSSSEPPSMTQLLRR

SEQ ID NO: 5793 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDSSAEPPSMTQLLRR

SEQ ID NO: 5794 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDSAGEPPSMTQLLRR

SEQ ID NO: 5795 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDSASEPPSMTQLLRR

SEQ ID NO: 5796 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDSAAEPPSMTQLLRR

SEQ ID NO: 5797 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDAGGEPPSMTQLLRR

SEQ ID NO: 5798 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDAGSEPPSMTQLLRR

SEQ ID NO: 5799 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDAGAEPPSMTQLLRR

SEQ ID NO: 5800 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDASGEPPSMTQLLRR

SEQ ID NO: 5801 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDASSEPPSMTQLLRR

SEQ ID NO: 5802 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDASAEPPSMTQLLRR

SEQ ID NO: 5803 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDAAGEPPSMTQLLRR

SEQ ID NO: 5804 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDAASEPPSMTQLLRR

SEQ ID NO: 5805 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKGGVSNKDIEKETAKDAAAEPPSMTQLLRR

SEQ ID NO: 5806 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDGGGEPPSMTQLLRR

SEQ ID NO: 5807 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDGGSEPPSMTQLLRR

SEQ ID NO: 5808 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDGGAEPPSMTQLLRR

SEQ ID NO: 5809 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDGSGEPPSMTQLLRR

SEQ ID NO: 5810 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDGSSEPPSMTQLLRR

SEQ ID NO: 5811 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDGSAEPPSMTQLLRR

SEQ ID NO: 5812 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDGAGEPPSMTQLLRR

SEQ ID NO: 5813 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDGASEPPSMTQLLRR

SEQ ID NO: 5814 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDGAAEPPSMTQLLRR

SEQ ID NO: 5815 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDSGGEPPSMTQLLRR

SEQ ID NO: 5816 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDSGSEPPSMTQLLRR

SEQ ID NO: 5817 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDSGAEPPSMTQLLRR

SEQ ID NO: 5818 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDSSGEPPSMTQLLRR

SEQ ID NO: 5819 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDSSSEPPSMTQLLRR

SEQ ID NO: 5820 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDSSAEPPSMTQLLRR

SEQ ID NO: 5821 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDSAGEPPSMTQLLRR

SEQ ID NO: 5822 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDSASEPPSMTQLLRR

SEQ ID NO: 5823 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDSAAEPPSMTQLLRR

SEQ ID NO: 5824 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDAGGEPPSMTQLLRR

SEQ ID NO: 5825 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDAGSEPPSMTQLLRR

SEQ ID NO: 5826 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDAGAEPPSMTQLLRR

SEQ ID NO: 5827 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDASGEPPSMTQLLRR

SEQ ID NO: 5828 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDASSEPPSMTQLLRR

SEQ ID NO: 5829 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDASAEPPSMTQLLRR

SEQ ID NO: 5830 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDAAGEPPSMTQLLRR

SEQ ID NO: 5831 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDAASEPPSMTQLLRR

SEQ ID NO: 5832 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKDGVSNKDIEKETAKDAAAEPPSMTQLLRR

SEQ ID NO: 5833 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDGGGEPPSMTQLLRR

SEQ ID NO: 5834 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDGGSEPPSMTQLLRR

SEQ ID NO: 5835 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDGGAEPPSMTQLLRR

SEQ ID NO: 5836 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDGSGEPPSMTQLLRR

SEQ ID NO: 5837 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDGSSEPPSMTQLLRR

SEQ ID NO: 5838 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDGSAEPPSMTQLLRR

SEQ ID NO: 5839 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDGAGEPPSMTQLLRR

SEQ ID NO: 5840 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDGASEPPSMTQLLRR

SEQ ID NO: 5841 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDGAAEPPSMTQLLRR

SEQ ID NO: 5842 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDSGGEPPSMTQLLRR

SEQ ID NO: 5843 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDSGSEPPSMTQLLRR

SEQ ID NO: 5844 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDSGAEPPSMTQLLRR

SEQ ID NO: 5845 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDSSGEPPSMTQLLRR

SEQ ID NO: 5846 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDSSSEPPSMTQLLRR

SEQ ID NO: 5847 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDSSAEPPSMTQLLRR

SEQ ID NO: 5848 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDSAGEPPSMTQLLRR

SEQ ID NO: 5849 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDSASEPPSMTQLLRR

SEQ ID NO: 5850 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDSAAEPPSMTQLLRR

SEQ ID NO: 5851 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDAGGEPPSMTQLLRR

SEQ ID NO: 5852 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDAGSEPPSMTQLLRR

SEQ ID NO: 5853 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDAGAEPPSMTQLLRR

SEQ ID NO: 5854 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDASGEPPSMTQLLRR

SEQ ID NO: 5855 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDASSEPPSMTQLLRR

SEQ ID NO: 5856 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDASAEPPSMTQLLRR

SEQ ID NO: 5857 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDAAGEPPSMTQLLRR

SEQ ID NO: 5858 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDAASEPPSMTQLLRR

SEQ ID NO: 5859 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKHGVSNKDIEKETAKDAAAEPPSMTQLLRR

SEQ ID NO: 5860 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDGGGEPPSMTQLLRR

SEQ ID NO: 5861 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDGGSEPPSMTQLLRR

SEQ ID NO: 5862 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDGGAEPPSMTQLLRR

SEQ ID NO: 5863 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDGSGEPPSMTQLLRR

SEQ ID NO: 5864 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDGSSEPPSMTQLLRR

SEQ ID NO: 5865 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDGSAEPPSMTQLLRR

SEQ ID NO: 5866 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDGAGEPPSMTQLLRR

SEQ ID NO: 5867 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDGASEPPSMTQLLRR

SEQ ID NO: 5868 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDGAAEPPSMTQLLRR

SEQ ID NO: 5869 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDSGGEPPSMTQLLRR

SEQ ID NO: 5870 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDSGSEPPSMTQLLRR

SEQ ID NO: 5871 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDSGAEPPSMTQLLRR

SEQ ID NO: 5872 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDSSGEPPSMTQLLRR

SEQ ID NO: 5873 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDSSSEPPSMTQLLRR

SEQ ID NO: 5874 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDSSAEPPSMTQLLRR

SEQ ID NO: 5875 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDSAGEPPSMTQLLRR

SEQ ID NO: 5876 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDSASEPPSMTQLLRR

SEQ ID NO: 5877 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDSAAEPPSMTQLLRR

SEQ ID NO: 5878 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDAGGEPPSMTQLLRR

SEQ ID NO: 5879 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDAGSEPPSMTQLLRR

SEQ ID NO: 5880 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDAGAEPPSMTQLLRR

SEQ ID NO: 5881 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDASGEPPSMTQLLRR

SEQ ID NO: 5882 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDASSEPPSMTQLLRR

SEQ ID NO: 5883 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDASAEPPSMTQLLRR

SEQ ID NO: 5884 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDAAGEPPSMTQLLRR

SEQ ID NO: 5885 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDAASEPPSMTQLLRR

SEQ ID NO: 5886 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKYGVSNKDIEKETAKDAAAEPPSMTQLLRR

SEQ ID NO: 5887 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDGGGEPPSMTQLLRR

SEQ ID NO: 5888 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDGGSEPPSMTQLLRR

SEQ ID NO: 5889 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDGGAEPPSMTQLLRR

SEQ ID NO: 5890 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDGSGEPPSMTQLLRR

SEQ ID NO: 5891 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDGSSEPPSMTQLLRR

SEQ ID NO: 5892 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDGSAEPPSMTQLLRR

SEQ ID NO: 5893 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDGAGEPPSMTQLLRR

SEQ ID NO: 5894 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDGASEPPSMTQLLRR

SEQ ID NO: 5895 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDGAAEPPSMTQLLRR

SEQ ID NO: 5896 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDSGGEPPSMTQLLRR

SEQ ID NO: 5897 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDSGSEPPSMTQLLRR

SEQ ID NO: 5898 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDSGAEPPSMTQLLRR

SEQ ID NO: 5899 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDSSGEPPSMTQLLRR

SEQ ID NO: 5900 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDSSSEPPSMTQLLRR

SEQ ID NO: 5901 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDSSAEPPSMTQLLRR

SEQ ID NO: 5902 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDSAGEPPSMTQLLRR

SEQ ID NO: 5903 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDSASEPPSMTQLLRR

SEQ ID NO: 5904 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDSAAEPPSMTQLLRR

SEQ ID NO: 5905 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDAGGEPPSMTQLLRR

SEQ ID NO: 5906 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDAGSEPPSMTQLLRR

SEQ ID NO: 5907 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDAGAEPPSMTQLLRR

SEQ ID NO: 5908 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDASGEPPSMTQLLRR

SEQ ID NO: 5909 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDASSEPPSMTQLLRR

SEQ ID NO: 5910 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDASAEPPSMTQLLRR

SEQ ID NO: 5911 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDAAGEPPSMTQLLRR

SEQ ID NO: 5912 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDAASEPPSMTQLLRR

SEQ ID NO: 5913 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKKGVSNKDIEKETAKDAAAEPPSMTQLLRR

SEQ ID NO: 5914 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDGGGEPPSMTQLLRR

SEQ ID NO: 5915 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDGGSEPPSMTQLLRR

SEQ ID NO: 5916 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDGGAEPPSMTQLLRR

SEQ ID NO: 5917 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDGSGEPPSMTQLLRR

SEQ ID NO: 5918 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDGSSEPPSMTQLLRR

SEQ ID NO: 5919 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDGSAEPPSMTQLLRR

SEQ ID NO: 5920 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDGAGEPPSMTQLLRR

SEQ ID NO: 5921 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDGASEPPSMTQLLRR

SEQ ID NO: 5922 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDGAAEPPSMTQLLRR

SEQ ID NO: 5923 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDSGGEPPSMTQLLRR

SEQ ID NO: 5924 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDSGSEPPSMTQLLRR

SEQ ID NO: 5925 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDSGAEPPSMTQLLRR

SEQ ID NO: 5926 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDSSGEPPSMTQLLRR

SEQ ID NO: 5927 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDSSSEPPSMTQLLRR

SEQ ID NO: 5928 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDSSAEPPSMTQLLRR

SEQ ID NO: 5929 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDSAGEPPSMTQLLRR

SEQ ID NO: 5930 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDSASEPPSMTQLLRR

SEQ ID NO: 5931 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDSAAEPPSMTQLLRR

SEQ ID NO: 5932 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDAGGEPPSMTQLLRR

SEQ ID NO: 5933 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDAGSEPPSMTQLLRR

SEQ ID NO: 5934 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDAGAEPPSMTQLLRR

SEQ ID NO: 5935 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDASGEPPSMTQLLRR

SEQ ID NO: 5936 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDASSEPPSMTQLLRR

SEQ ID NO: 5937 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDASAEPPSMTQLLRR

SEQ ID NO: 5938 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDAAGEPPSMTQLLRR

SEQ ID NO: 5939 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDAASEPPSMTQLLRR

SEQ ID NO: 5940 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKNGVSNKDIEKETAKDAAAEPPSMTQLLRR

SEQ ID NO: 5941 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDGGGEPPSMTQLLRR

SEQ ID NO: 5942 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDGGSEPPSMTQLLRR

SEQ ID NO: 5943 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDGGAEPPSMTQLLRR

SEQ ID NO: 5944 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDGSGEPPSMTQLLRR

SEQ ID NO: 5945 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDGSSEPPSMTQLLRR

SEQ ID NO: 5946 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDGSAEPPSMTQLLRR

SEQ ID NO: 5947 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDGAGEPPSMTQLLRR

SEQ ID NO: 5948 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDGASEPPSMTQLLRR

SEQ ID NO: 5949 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDGAAEPPSMTQLLRR

SEQ ID NO: 5950 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDSGGEPPSMTQLLRR

SEQ ID NO: 5951 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDSGSEPPSMTQLLRR

SEQ ID NO: 5952 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDSGAEPPSMTQLLRR

SEQ ID NO: 5953 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDSSGEPPSMTQLLRR

SEQ ID NO: 5954 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDSSSEPPSMTQLLRR

SEQ ID NO: 5955 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDSSAEPPSMTQLLRR

SEQ ID NO: 5956 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDSAGEPPSMTQLLRR

SEQ ID NO: 5957 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDSASEPPSMTQLLRR

SEQ ID NO: 5958 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDSAAEPPSMTQLLRR

SEQ ID NO: 5959 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDAGGEPPSMTQLLRR

SEQ ID NO: 5960 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDAGSEPPSMTQLLRR

SEQ ID NO: 5961 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDAGAEPPSMTQLLRR

SEQ ID NO: 5962 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDASGEPPSMTQLLRR

SEQ ID NO: 5963 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDASSEPPSMTQLLRR

SEQ ID NO: 5964 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDASAEPPSMTQLLRR

SEQ ID NO: 5965 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDAAGEPPSMTQLLRR

SEQ ID NO: 5966 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDAASEPPSMTQLLRR

SEQ ID NO: 5967 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDSFGLRGLLHLENASYGIEPLQNSSHFEHIIYRMDDVYKEPLKMGVSNKDIEKETAKDAAAEPPSMTQLLRR

SEQ ID NO: 5968 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDGGGEPPSMTQLLRR

SEQ ID NO: 5969 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDGGSEPPSMTQLLRR

SEQ ID NO: 5970 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDGGAEPPSMTQLLRR

SEQ ID NO: 5971 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDGSGEPPSMTQLLRR

SEQ ID NO: 5972 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDGSSEPPSMTQLLRR

SEQ ID NO: 5973 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDGSAEPPSMTQLLRR

SEQ ID NO: 5974 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDGAGEPPSMTQLLRR

SEQ ID NO: 5975 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDGASEPPSMTQLLRR

SEQ ID NO: 5976 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDGAAEPPSMTQLLRR

SEQ ID NO: 5977 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDSGGEPPSMTQLLRR

SEQ ID NO: 5978 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDSGSEPPSMTQLLRR

SEQ ID NO: 5979 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDSGAEPPSMTQLLRR

SEQ ID NO: 5980 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDSSGEPPSMTQLLRR

SEQ ID NO: 5981 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDSSSEPPSMTQLLRR

SEQ ID NO: 5982 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDSSAEPPSMTQLLRR

SEQ ID NO: 5983 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDSAGEPPSMTQLLRR

SEQ ID NO: 5984 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDSASEPPSMTQLLRR

SEQ ID NO: 5985 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDSAAEPPSMTQLLRR

SEQ ID NO: 5986 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDAGGEPPSMTQLLRR

SEQ ID NO: 5987 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDAGSEPPSMTQLLRR

SEQ ID NO: 5988 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDAGAEPPSMTQLLRR

SEQ ID NO: 5989 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDASGEPPSMTQLLRR

SEQ ID NO: 5990 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDASSEPPSMTQLLRR

SEQ ID NO: 5991 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDASAEPPSMTQLLRR

SEQ ID NO: 5992 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDAAGEPPSMTQLLRR

SEQ ID NO: 5993 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDAASEPPSMTQLLRR

SEQ ID NO: 5994 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKCGVSNKDIEKETAKDAAAEPPSMTQLLRR

SEQ ID NO: 5995 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDGGGEPPSMTQLLRR

SEQ ID NO: 5996 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDGGSEPPSMTQLLRR

SEQ ID NO: 5997 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDGGAEPPSMTQLLRR

SEQ ID NO: 5998 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDGSGEPPSMTQLLRR

SEQ ID NO: 5999 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDGSSEPPSMTQLLRR

SEQ ID NO: 6000 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDGSAEPPSMTQLLRR

SEQ ID NO: 6001 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDGAGEPPSMTQLLRR

SEQ ID NO: 6002 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDGASEPPSMTQLLRR

SEQ ID NO: 6003 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDGAAEPPSMTQLLRR

SEQ ID NO: 6004 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDSGGEPPSMTQLLRR

SEQ ID NO: 6005 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDSGSEPPSMTQLLRR

SEQ ID NO: 6006 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDSGAEPPSMTQLLRR

SEQ ID NO: 6007 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDSSGEPPSMTQLLRR

SEQ ID NO: 6008 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDSSSEPPSMTQLLRR

SEQ ID NO: 6009 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDSSAEPPSMTQLLRR

SEQ ID NO: 6010 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDSAGEPPSMTQLLRR

SEQ ID NO: 6011 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDSASEPPSMTQLLRR

SEQ ID NO: 6012 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDSAAEPPSMTQLLRR

SEQ ID NO: 6013 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDAGGEPPSMTQLLRR

SEQ ID NO: 6014 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDAGSEPPSMTQLLRR

SEQ ID NO: 6015 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDAGAEPPSMTQLLRR

SEQ ID NO: 6016 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDASGEPPSMTQLLRR

SEQ ID NO: 6017 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDASSEPPSMTQLLRR

SEQ ID NO: 6018 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDASAEPPSMTQLLRR

SEQ ID NO: 6019 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDAAGEPPSMTQLLRR

SEQ ID NO: 6020 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDAASEPPSMTQLLRR

SEQ ID NO: 6021 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKSGVSNKDIEKETAKDAAAEPPSMTQLLRR

SEQ ID NO: 6022 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDGGGEPPSMTQLLRR

SEQ ID NO: 6023 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDGGSEPPSMTQLLRR

SEQ ID NO: 6024 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDGGAEPPSMTQLLRR

SEQ ID NO: 6025 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDGSGEPPSMTQLLRR

SEQ ID NO: 6026 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDGSSEPPSMTQLLRR

SEQ ID NO: 6027 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDGSAEPPSMTQLLRR

SEQ ID NO: 6028 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDGAGEPPSMTQLLRR

SEQ ID NO: 6029 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDGASEPPSMTQLLRR

SEQ ID NO: 6030 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDGAAEPPSMTQLLRR

SEQ ID NO: 6031 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDSGGEPPSMTQLLRR

SEQ ID NO: 6032 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDSGSEPPSMTQLLRR

SEQ ID NO: 6033 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDSGAEPPSMTQLLRR

SEQ ID NO: 6034 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDSSGEPPSMTQLLRR

SEQ ID NO: 6035 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDSSSEPPSMTQLLRR

SEQ ID NO: 6036 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDSSAEPPSMTQLLRR

SEQ ID NO: 6037 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDSAGEPPSMTQLLRR

SEQ ID NO: 6038 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDSASEPPSMTQLLRR

SEQ ID NO: 6039 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDSAAEPPSMTQLLRR

SEQ ID NO: 6040 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDAGGEPPSMTQLLRR

SEQ ID NO: 6041 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDAGSEPPSMTQLLRR

SEQ ID NO: 6042 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDAGAEPPSMTQLLRR

SEQ ID NO: 6043 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDASGEPPSMTQLLRR

SEQ ID NO: 6044 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDASSEPPSMTQLLRR

SEQ ID NO: 6045 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDASAEPPSMTQLLRR

SEQ ID NO: 6046 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDAAGEPPSMTQLLRR

SEQ ID NO: 6047 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDAASEPPSMTQLLRR

SEQ ID NO: 6048 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKAGVSNKDIEKETAKDAAAEPPSMTQLLRR

SEQ ID NO: 6049 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDGGGEPPSMTQLLRR

SEQ ID NO: 6050 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDGGSEPPSMTQLLRR

SEQ ID NO: 6051 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDGGAEPPSMTQLLRR

SEQ ID NO: 6052 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDGSGEPPSMTQLLRR

SEQ ID NO: 6053 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDGSSEPPSMTQLLRR

SEQ ID NO: 6054 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDGSAEPPSMTQLLRR

SEQ ID NO: 6055 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDGAGEPPSMTQLLRR

SEQ ID NO: 6056 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDGASEPPSMTQLLRR

SEQ ID NO: 6057 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDGAAEPPSMTQLLRR

SEQ ID NO: 6058 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDSGGEPPSMTQLLRR

SEQ ID NO: 6059 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDSGSEPPSMTQLLRR

SEQ ID NO: 6060 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDSGAEPPSMTQLLRR

SEQ ID NO: 6061 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDSSGEPPSMTQLLRR

SEQ ID NO: 6062 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDSSSEPPSMTQLLRR

SEQ ID NO: 6063 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDSSAEPPSMTQLLRR

SEQ ID NO: 6064 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDSAGEPPSMTQLLRR

SEQ ID NO: 6065 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDSASEPPSMTQLLRR

SEQ ID NO: 6066 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDSAAEPPSMTQLLRR

SEQ ID NO: 6067 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDAGGEPPSMTQLLRR

SEQ ID NO: 6068 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDAGSEPPSMTQLLRR

SEQ ID NO: 6069 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDAGAEPPSMTQLLRR

SEQ ID NO: 6070 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDASGEPPSMTQLLRR

SEQ ID NO: 6071 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDASSEPPSMTQLLRR

SEQ ID NO: 6072 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDASAEPPSMTQLLRR

SEQ ID NO: 6073 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDAAGEPPSMTQLLRR

SEQ ID NO: 6074 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDAASEPPSMTQLLRR

SEQ ID NO: 6075 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKGGVSNKDIEKETAKDAAAEPPSMTQLLRR

SEQ ID NO: 6076 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDGGGEPPSMTQLLRR

SEQ ID NO: 6077 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDGGSEPPSMTQLLRR

SEQ ID NO: 6078 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDGGAEPPSMTQLLRR

SEQ ID NO: 6079 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDGSGEPPSMTQLLRR

SEQ ID NO: 6080 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDGSSEPPSMTQLLRR

SEQ ID NO: 6081 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDGSAEPPSMTQLLRR

SEQ ID NO: 6082 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDGAGEPPSMTQLLRR

SEQ ID NO: 6083 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDGASEPPSMTQLLRR

SEQ ID NO: 6084 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDGAAEPPSMTQLLRR

SEQ ID NO: 6085 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDSGGEPPSMTQLLRR

SEQ ID NO: 6086 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDSGSEPPSMTQLLRR

SEQ ID NO: 6087 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDSGAEPPSMTQLLRR

SEQ ID NO: 6088 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDSSGEPPSMTQLLRR

SEQ ID NO: 6089 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDSSSEPPSMTQLLRR

SEQ ID NO: 6090 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDSSAEPPSMTQLLRR

SEQ ID NO: 6091 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDSAGEPPSMTQLLRR

SEQ ID NO: 6092 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDSASEPPSMTQLLRR

SEQ ID NO: 6093 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDSAAEPPSMTQLLRR

SEQ ID NO: 6094 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDAGGEPPSMTQLLRR

SEQ ID NO: 6095 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDAGSEPPSMTQLLRR

SEQ ID NO: 6096 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDAGAEPPSMTQLLRR

SEQ ID NO: 6097 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDASGEPPSMTQLLRR

SEQ ID NO: 6098 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDASSEPPSMTQLLRR

SEQ ID NO: 6099 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDASAEPPSMTQLLRR

SEQ ID NO: 6100 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDAAGEPPSMTQLLRR

SEQ ID NO: 6101 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDAASEPPSMTQLLRR

SEQ ID NO: 6102 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKDGVSNKDIEKETAKDAAAEPPSMTQLLRR

SEQ ID NO: 6103 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDGGGEPPSMTQLLRR

SEQ ID NO: 6104 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDGGSEPPSMTQLLRR

SEQ ID NO: 6105 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDGGAEPPSMTQLLRR

SEQ ID NO: 6106 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDGSGEPPSMTQLLRR

SEQ ID NO: 6107 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDGSSEPPSMTQLLRR

SEQ ID NO: 6108 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDGSAEPPSMTQLLRR

SEQ ID NO: 6109 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDGAGEPPSMTQLLRR

SEQ ID NO: 6110 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDGASEPPSMTQLLRR

SEQ ID NO: 6111 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDGAAEPPSMTQLLRR

SEQ ID NO: 6112 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDSGGEPPSMTQLLRR

SEQ ID NO: 6113 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDSGSEPPSMTQLLRR

SEQ ID NO: 6114 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDSGAEPPSMTQLLRR

SEQ ID NO: 6115 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDSSGEPPSMTQLLRR

SEQ ID NO: 6116 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDSSSEPPSMTQLLRR

SEQ ID NO: 6117 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDSSAEPPSMTQLLRR

SEQ ID NO: 6118 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDSAGEPPSMTQLLRR

SEQ ID NO: 6119 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDSASEPPSMTQLLRR

SEQ ID NO: 6120 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDSAAEPPSMTQLLRR

SEQ ID NO: 6121 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDAGGEPPSMTQLLRR

SEQ ID NO: 6122 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDAGSEPPSMTQLLRR

SEQ ID NO: 6123 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDAGAEPPSMTQLLRR

SEQ ID NO: 6124 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDASGEPPSMTQLLRR

SEQ ID NO: 6125 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDASSEPPSMTQLLRR

SEQ ID NO: 6126 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDASAEPPSMTQLLRR

SEQ ID NO: 6127 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDAAGEPPSMTQLLRR

SEQ ID NO: 6128 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDAASEPPSMTQLLRR

SEQ ID NO: 6129 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKHGVSNKDIEKETAKDAAAEPPSMTQLLRR

SEQ ID NO: 6130 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDGGGEPPSMTQLLRR

SEQ ID NO: 6131 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDGGSEPPSMTQLLRR

SEQ ID NO: 6132 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDGGAEPPSMTQLLRR

SEQ ID NO: 6133 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDGSGEPPSMTQLLRR

SEQ ID NO: 6134 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDGSSEPPSMTQLLRR

SEQ ID NO: 6135 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDGSAEPPSMTQLLRR

SEQ ID NO: 6136 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDGAGEPPSMTQLLRR

SEQ ID NO: 6137 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDGASEPPSMTQLLRR

SEQ ID NO: 6138 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDGAAEPPSMTQLLRR

SEQ ID NO: 6139 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDSGGEPPSMTQLLRR

SEQ ID NO: 6140 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDSGSEPPSMTQLLRR

SEQ ID NO: 6141 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDSGAEPPSMTQLLRR

SEQ ID NO: 6142 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDSSGEPPSMTQLLRR

SEQ ID NO: 6143 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDSSSEPPSMTQLLRR

SEQ ID NO: 6144 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDSSAEPPSMTQLLRR

SEQ ID NO: 6145 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDSAGEPPSMTQLLRR

SEQ ID NO: 6146 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDSASEPPSMTQLLRR

SEQ ID NO: 6147 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDSAAEPPSMTQLLRR

SEQ ID NO: 6148 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDAGGEPPSMTQLLRR

SEQ ID NO: 6149 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDAGSEPPSMTQLLRR

SEQ ID NO: 6150 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDAGAEPPSMTQLLRR

SEQ ID NO: 6151 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDASGEPPSMTQLLRR

SEQ ID NO: 6152 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDASSEPPSMTQLLRR

SEQ ID NO: 6153 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDASAEPPSMTQLLRR

SEQ ID NO: 6154 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDAAGEPPSMTQLLRR

SEQ ID NO: 6155 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDAASEPPSMTQLLRR

SEQ ID NO: 6156 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKYGVSNKDIEKETAKDAAAEPPSMTQLLRR

SEQ ID NO: 6157 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDGGGEPPSMTQLLRR

SEQ ID NO: 6158 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDGGSEPPSMTQLLRR

SEQ ID NO: 6159 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDGGAEPPSMTQLLRR

SEQ ID NO: 6160 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDGSGEPPSMTQLLRR

SEQ ID NO: 6161 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDGSSEPPSMTQLLRR

SEQ ID NO: 6162 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDGSAEPPSMTQLLRR

SEQ ID NO: 6163 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDGAGEPPSMTQLLRR

SEQ ID NO: 6164 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDGASEPPSMTQLLRR

SEQ ID NO: 6165 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDGAAEPPSMTQLLRR

SEQ ID NO: 6166 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDSGGEPPSMTQLLRR

SEQ ID NO: 6167 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDSGSEPPSMTQLLRR

SEQ ID NO: 6168 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDSGAEPPSMTQLLRR

SEQ ID NO: 6169 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDSSGEPPSMTQLLRR

SEQ ID NO: 6170 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDSSSEPPSMTQLLRR

SEQ ID NO: 6171 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDSSAEPPSMTQLLRR

SEQ ID NO: 6172 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDSAGEPPSMTQLLRR

SEQ ID NO: 6173 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDSASEPPSMTQLLRR

SEQ ID NO: 6174 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDSAAEPPSMTQLLRR

SEQ ID NO: 6175 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDAGGEPPSMTQLLRR

SEQ ID NO: 6176 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDAGSEPPSMTQLLRR

SEQ ID NO: 6177 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDAGAEPPSMTQLLRR

SEQ ID NO: 6178 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDASGEPPSMTQLLRR

SEQ ID NO: 6179 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDASSEPPSMTQLLRR

SEQ ID NO: 6180 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDASAEPPSMTQLLRR

SEQ ID NO: 6181 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDAAGEPPSMTQLLRR

SEQ ID NO: 6182 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDAASEPPSMTQLLRR

SEQ ID NO: 6183 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKKGVSNKDIEKETAKDAAAEPPSMTQLLRR

SEQ ID NO: 6184 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDGGGEPPSMTQLLRR

SEQ ID NO: 6185 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDGGSEPPSMTQLLRR

SEQ ID NO: 6186 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDGGAEPPSMTQLLRR

SEQ ID NO: 6187 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDGSGEPPSMTQLLRR

SEQ ID NO: 6188 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDGSSEPPSMTQLLRR

SEQ ID NO: 6189 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDGSAEPPSMTQLLRR

SEQ ID NO: 6190 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDGAGEPPSMTQLLRR

SEQ ID NO: 6191 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDGASEPPSMTQLLRR

SEQ ID NO: 6192 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDGAAEPPSMTQLLRR

SEQ ID NO: 6193 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDSGGEPPSMTQLLRR

SEQ ID NO: 6194 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDSGSEPPSMTQLLRR

SEQ ID NO: 6195 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDSGAEPPSMTQLLRR

SEQ ID NO: 6196 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDSSGEPPSMTQLLRR

SEQ ID NO: 6197 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDSSSEPPSMTQLLRR

SEQ ID NO: 6198 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDSSAEPPSMTQLLRR

SEQ ID NO: 6199 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDSAGEPPSMTQLLRR

SEQ ID NO: 6200 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDSASEPPSMTQLLRR

SEQ ID NO: 6201 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDSAAEPPSMTQLLRR

SEQ ID NO: 6202 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDAGGEPPSMTQLLRR

SEQ ID NO: 6203 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDAGSEPPSMTQLLRR

SEQ ID NO: 6204 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDAGAEPPSMTQLLRR

SEQ ID NO: 6205 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDASGEPPSMTQLLRR

SEQ ID NO: 6206 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDASSEPPSMTQLLRR

SEQ ID NO: 6207 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDASAEPPSMTQLLRR

SEQ ID NO: 6208 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDAAGEPPSMTQLLRR

SEQ ID NO: 6209 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDAASEPPSMTQLLRR

SEQ ID NO: 6210 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKNGVSNKDIEKETAKDAAAEPPSMTQLLRR

SEQ ID NO: 6211 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDGGGEPPSMTQLLRR

SEQ ID NO: 6212 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDGGSEPPSMTQLLRR

SEQ ID NO: 6213 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDGGAEPPSMTQLLRR

SEQ ID NO: 6214 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDGSGEPPSMTQLLRR

SEQ ID NO: 6215 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDGSSEPPSMTQLLRR

SEQ ID NO: 6216 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDGSAEPPSMTQLLRR

SEQ ID NO: 6217 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDGAGEPPSMTQLLRR

SEQ ID NO: 6218 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDGASEPPSMTQLLRR

SEQ ID NO: 6219 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDGAAEPPSMTQLLRR

SEQ ID NO: 6220 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDSGGEPPSMTQLLRR

SEQ ID NO: 6221 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDSGSEPPSMTQLLRR

SEQ ID NO: 6222 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDSGAEPPSMTQLLRR

SEQ ID NO: 6223 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDSSGEPPSMTQLLRR

SEQ ID NO: 6224 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDSSSEPPSMTQLLRR

SEQ ID NO: 6225 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDSSAEPPSMTQLLRR

SEQ ID NO: 6226 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDSAGEPPSMTQLLRR

SEQ ID NO: 6227 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDSASEPPSMTQLLRR

SEQ ID NO: 6228 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDSAAEPPSMTQLLRR

SEQ ID NO: 6229 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDAGGEPPSMTQLLRR

SEQ ID NO: 6230 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDAGSEPPSMTQLLRR

SEQ ID NO: 6231 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDAGAEPPSMTQLLRR

SEQ ID NO: 6232 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDASGEPPSMTQLLRR

SEQ ID NO: 6233 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDASSEPPSMTQLLRR

SEQ ID NO: 6234 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDASAEPPSMTQLLRR

SEQ ID NO: 6235 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDAAGEPPSMTQLLRR

SEQ ID NO: 6236 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDAASEPPSMTQLLRR

SEQ ID NO: 6237 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDAFGLRGLLHLENASYGIEPLQNSSHFEHIIYRMDDVYKEPLKMGVSNKDIEKETAKDAAAEPPSMTQLLRR

SEQ ID NO: 6238 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDGGGEPPSMTQLLRR

SEQ ID NO: 6239 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDGGSEPPSMTQLLRR

SEQ ID NO: 6240 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDGGAEPPSMTQLLRR

SEQ ID NO: 6241 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDGSGEPPSMTQLLRR

SEQ ID NO: 6242 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDGSSEPPSMTQLLRR

SEQ ID NO: 6243 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDGSAEPPSMTQLLRR

SEQ ID NO: 6244 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDGAGEPPSMTQLLRR

SEQ ID NO: 6245 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDGASEPPSMTQLLRR

SEQ ID NO: 6246 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDGAAEPPSMTQLLRR

SEQ ID NO: 6247 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDSGGEPPSMTQLLRR

SEQ ID NO: 6248 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDSGSEPPSMTQLLRR

SEQ ID NO: 6249 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDSGAEPPSMTQLLRR

SEQ ID NO: 6250 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDSSGEPPSMTQLLRR

SEQ ID NO: 6251 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDSSSEPPSMTQLLRR

SEQ ID NO: 6252 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDSSAEPPSMTQLLRR

SEQ ID NO: 6253 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDSAGEPPSMTQLLRR

SEQ ID NO: 6254 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDSASEPPSMTQLLRR

SEQ ID NO: 6255 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDSAAEPPSMTQLLRR

SEQ ID NO: 6256 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDAGGEPPSMTQLLRR

SEQ ID NO: 6257 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDAGSEPPSMTQLLRR

SEQ ID NO: 6258 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDAGAEPPSMTQLLRR

SEQ ID NO: 6259 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDASGEPPSMTQLLRR

SEQ ID NO: 6260 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDASSEPPSMTQLLRR

SEQ ID NO: 6261 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDASAEPPSMTQLLRR

SEQ ID NO: 6262 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDAAGEPPSMTQLLRR

SEQ ID NO: 6263 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDAASEPPSMTQLLRR

SEQ ID NO: 6264 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKCGVSNKDIEKETAKDAAAEPPSMTQLLRR

SEQ ID NO: 6265 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDGGGEPPSMTQLLRR

SEQ ID NO: 6266 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDGGSEPPSMTQLLRR

SEQ ID NO: 6267 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDGGAEPPSMTQLLRR

SEQ ID NO: 6268 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDGSGEPPSMTQLLRR

SEQ ID NO: 6269 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDGSSEPPSMTQLLRR

SEQ ID NO: 6270 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDGSAEPPSMTQLLRR

SEQ ID NO: 6271 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDGAGEPPSMTQLLRR

SEQ ID NO: 6272 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDGASEPPSMTQLLRR

SEQ ID NO: 6273 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDGAAEPPSMTQLLRR

SEQ ID NO: 6274 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDSGGEPPSMTQLLRR

SEQ ID NO: 6275 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDSGSEPPSMTQLLRR

SEQ ID NO: 6276 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDSGAEPPSMTQLLRR

SEQ ID NO: 6277 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDSSGEPPSMTQLLRR

SEQ ID NO: 6278 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDSSSEPPSMTQLLRR

SEQ ID NO: 6279 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDSSAEPPSMTQLLRR

SEQ ID NO: 6280 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDSAGEPPSMTQLLRR

SEQ ID NO: 6281 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDSASEPPSMTQLLRR

SEQ ID NO: 6282 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDSAAEPPSMTQLLRR

SEQ ID NO: 6283 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDAGGEPPSMTQLLRR

SEQ ID NO: 6284 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDAGSEPPSMTQLLRR

SEQ ID NO: 6285 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDAGAEPPSMTQLLRR

SEQ ID NO: 6286 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDASGEPPSMTQLLRR

SEQ ID NO: 6287 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDASSEPPSMTQLLRR

SEQ ID NO: 6288 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDASAEPPSMTQLLRR

SEQ ID NO: 6289 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDAAGEPPSMTQLLRR

SEQ ID NO: 6290 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDAASEPPSMTQLLRR

SEQ ID NO: 6291 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKSGVSNKDIEKETAKDAAAEPPSMTQLLRR

SEQ ID NO: 6292 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDGGGEPPSMTQLLRR

SEQ ID NO: 6293 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDGGSEPPSMTQLLRR

SEQ ID NO: 6294 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDGGAEPPSMTQLLRR

SEQ ID NO: 6295 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDGSGEPPSMTQLLRR

SEQ ID NO: 6296 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDGSSEPPSMTQLLRR

SEQ ID NO: 6297 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDGSAEPPSMTQLLRR

SEQ ID NO: 6298 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDGAGEPPSMTQLLRR

SEQ ID NO: 6299 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDGASEPPSMTQLLRR

SEQ ID NO: 6300 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDGAAEPPSMTQLLRR

SEQ ID NO: 6301 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDSGGEPPSMTQLLRR

SEQ ID NO: 6302 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDSGSEPPSMTQLLRR

SEQ ID NO: 6303 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDSGAEPPSMTQLLRR

SEQ ID NO: 6304 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDSSGEPPSMTQLLRR

SEQ ID NO: 6305 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDSSSEPPSMTQLLRR

SEQ ID NO: 6306 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDSSAEPPSMTQLLRR

SEQ ID NO: 6307 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDSAGEPPSMTQLLRR

SEQ ID NO: 6308 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDSASEPPSMTQLLRR

SEQ ID NO: 6309 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDSAAEPPSMTQLLRR

SEQ ID NO: 6310 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDAGGEPPSMTQLLRR

SEQ ID NO: 6311 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDAGSEPPSMTQLLRR

SEQ ID NO: 6312 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDAGAEPPSMTQLLRR

SEQ ID NO: 6313 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDASGEPPSMTQLLRR

SEQ ID NO: 6314 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDASSEPPSMTQLLRR

SEQ ID NO: 6315 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDASAEPPSMTQLLRR

SEQ ID NO: 6316 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDAAGEPPSMTQLLRR

SEQ ID NO: 6317 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDAASEPPSMTQLLRR

SEQ ID NO: 6318 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKAGVSNKDIEKETAKDAAAEPPSMTQLLRR

SEQ ID NO: 6319 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDGGGEPPSMTQLLRR

SEQ ID NO: 6320 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDGGSEPPSMTQLLRR

SEQ ID NO: 6321 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDGGAEPPSMTQLLRR

SEQ ID NO: 6322 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDGSGEPPSMTQLLRR

SEQ ID NO: 6323 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDGSSEPPSMTQLLRR

SEQ ID NO: 6324 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDGSAEPPSMTQLLRR

SEQ ID NO: 6325 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDGAGEPPSMTQLLRR

SEQ ID NO: 6326 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDGASEPPSMTQLLRR

SEQ ID NO: 6327 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDGAAEPPSMTQLLRR

SEQ ID NO: 6328 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDSGGEPPSMTQLLRR

SEQ ID NO: 6329 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDSGSEPPSMTQLLRR

SEQ ID NO: 6330 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDSGAEPPSMTQLLRR

SEQ ID NO: 6331 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDSSGEPPSMTQLLRR

SEQ ID NO: 6332 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDSSSEPPSMTQLLRR

SEQ ID NO: 6333 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDSSAEPPSMTQLLRR

SEQ ID NO: 6334 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDSAGEPPSMTQLLRR

SEQ ID NO: 6335 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDSASEPPSMTQLLRR

SEQ ID NO: 6336 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDSAAEPPSMTQLLRR

SEQ ID NO: 6337 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDAGGEPPSMTQLLRR

SEQ ID NO: 6338 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDAGSEPPSMTQLLRR

SEQ ID NO: 6339 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDAGAEPPSMTQLLRR

SEQ ID NO: 6340 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDASGEPPSMTQLLRR

SEQ ID NO: 6341 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDASSEPPSMTQLLRR

SEQ ID NO: 6342 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDASAEPPSMTQLLRR

SEQ ID NO: 6343 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDAAGEPPSMTQLLRR

SEQ ID NO: 6344 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDAASEPPSMTQLLRR

SEQ ID NO: 6345 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKGGVSNKDIEKETAKDAAAEPPSMTQLLRR

SEQ ID NO: 6346 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDGGGEPPSMTQLLRR

SEQ ID NO: 6347 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDGGSEPPSMTQLLRR

SEQ ID NO: 6348 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDGGAEPPSMTQLLRR

SEQ ID NO: 6349 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDGSGEPPSMTQLLRR

SEQ ID NO: 6350 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDGSSEPPSMTQLLRR

SEQ ID NO: 6351 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDGSAEPPSMTQLLRR

SEQ ID NO: 6352 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDGAGEPPSMTQLLRR

SEQ ID NO: 6353 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDGASEPPSMTQLLRR

SEQ ID NO: 6354 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDGAAEPPSMTQLLRR

SEQ ID NO: 6355 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDSGGEPPSMTQLLRR

SEQ ID NO: 6356 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDSGSEPPSMTQLLRR

SEQ ID NO: 6357 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDSGAEPPSMTQLLRR

SEQ ID NO: 6358 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDSSGEPPSMTQLLRR

SEQ ID NO: 6359 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDSSSEPPSMTQLLRR

SEQ ID NO: 6360 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDSSAEPPSMTQLLRR

SEQ ID NO: 6361 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDSAGEPPSMTQLLRR

SEQ ID NO: 6362 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDSASEPPSMTQLLRR

SEQ ID NO: 6363 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDSAAEPPSMTQLLRR

SEQ ID NO: 6364 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDAGGEPPSMTQLLRR

SEQ ID NO: 6365 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDAGSEPPSMTQLLRR

SEQ ID NO: 6366 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDAGAEPPSMTQLLRR

SEQ ID NO: 6367 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDASGEPPSMTQLLRR

SEQ ID NO: 6368 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDASSEPPSMTQLLRR

SEQ ID NO: 6369 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDASAEPPSMTQLLRR

SEQ ID NO: 6370 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDAAGEPPSMTQLLRR

SEQ ID NO: 6371 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDAASEPPSMTQLLRR

SEQ ID NO: 6372 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKDGVSNKDIEKETAKDAAAEPPSMTQLLRR

SEQ ID NO: 6373 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDGGGEPPSMTQLLRR

SEQ ID NO: 6374 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDGGSEPPSMTQLLRR

SEQ ID NO: 6375 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDGGAEPPSMTQLLRR

SEQ ID NO: 6376 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDGSGEPPSMTQLLRR

SEQ ID NO: 6377 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDGSSEPPSMTQLLRR

SEQ ID NO: 6378 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDGSAEPPSMTQLLRR

SEQ ID NO: 6379 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDGAGEPPSMTQLLRR

SEQ ID NO: 6380 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDGASEPPSMTQLLRR

SEQ ID NO: 6381 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDGAAEPPSMTQLLRR

SEQ ID NO: 6382 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDSGGEPPSMTQLLRR

SEQ ID NO: 6383 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDSGSEPPSMTQLLRR

SEQ ID NO: 6384 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDSGAEPPSMTQLLRR

SEQ ID NO: 6385 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDSSGEPPSMTQLLRR

SEQ ID NO: 6386 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDSSSEPPSMTQLLRR

SEQ ID NO: 6387 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDSSAEPPSMTQLLRR

SEQ ID NO: 6388 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDSAGEPPSMTQLLRR

SEQ ID NO: 6389 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDSASEPPSMTQLLRR

SEQ ID NO: 6390 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDSAAEPPSMTQLLRR

SEQ ID NO: 6391 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDAGGEPPSMTQLLRR

SEQ ID NO: 6392 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDAGSEPPSMTQLLRR

SEQ ID NO: 6393 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDAGAEPPSMTQLLRR

SEQ ID NO: 6394 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDASGEPPSMTQLLRR

SEQ ID NO: 6395 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDASSEPPSMTQLLRR

SEQ ID NO: 6396 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDASAEPPSMTQLLRR

SEQ ID NO: 6397 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDAAGEPPSMTQLLRR

SEQ ID NO: 6398 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDAASEPPSMTQLLRR

SEQ ID NO: 6399 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKHGVSNKDIEKETAKDAAAEPPSMTQLLRR

SEQ ID NO: 6400 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDGGGEPPSMTQLLRR

SEQ ID NO: 6401 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDGGSEPPSMTQLLRR

SEQ ID NO: 6402 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDGGAEPPSMTQLLRR

SEQ ID NO: 6403 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDGSGEPPSMTQLLRR

SEQ ID NO: 6404 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDGSSEPPSMTQLLRR

SEQ ID NO: 6405 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDGSAEPPSMTQLLRR

SEQ ID NO: 6406 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDGAGEPPSMTQLLRR

SEQ ID NO: 6407 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDGASEPPSMTQLLRR

SEQ ID NO: 6408 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDGAAEPPSMTQLLRR

SEQ ID NO: 6409 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDSGGEPPSMTQLLRR

SEQ ID NO: 6410 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDSGSEPPSMTQLLRR

SEQ ID NO: 6411 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDSGAEPPSMTQLLRR

SEQ ID NO: 6412 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDSSGEPPSMTQLLRR

SEQ ID NO: 6413 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDSSSEPPSMTQLLRR

SEQ ID NO: 6414 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDSSAEPPSMTQLLRR

SEQ ID NO: 6415 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDSAGEPPSMTQLLRR

SEQ ID NO: 6416 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDSASEPPSMTQLLRR

SEQ ID NO: 6417 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDSAAEPPSMTQLLRR

SEQ ID NO: 6418 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDAGGEPPSMTQLLRR

SEQ ID NO: 6419 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDAGSEPPSMTQLLRR

SEQ ID NO: 6420 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDAGAEPPSMTQLLRR

SEQ ID NO: 6421 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDASGEPPSMTQLLRR

SEQ ID NO: 6422 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDASSEPPSMTQLLRR

SEQ ID NO: 6423 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDASAEPPSMTQLLRR

SEQ ID NO: 6424 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDAAGEPPSMTQLLRR

SEQ ID NO: 6425 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDAASEPPSMTQLLRR

SEQ ID NO: 6426 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKYGVSNKDIEKETAKDAAAEPPSMTQLLRR

SEQ ID NO: 6427 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDGGGEPPSMTQLLRR

SEQ ID NO: 6428 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDGGSEPPSMTQLLRR

SEQ ID NO: 6429 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDGGAEPPSMTQLLRR

SEQ ID NO: 6430 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDGSGEPPSMTQLLRR

SEQ ID NO: 6431 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDGSSEPPSMTQLLRR

SEQ ID NO: 6432 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDGSAEPPSMTQLLRR

SEQ ID NO: 6433 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDGAGEPPSMTQLLRR

SEQ ID NO: 6434 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDGASEPPSMTQLLRR

SEQ ID NO: 6435 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDGAAEPPSMTQLLRR

SEQ ID NO: 6436 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDSGGEPPSMTQLLRR

SEQ ID NO: 6437 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDSGSEPPSMTQLLRR

SEQ ID NO: 6438 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDSGAEPPSMTQLLRR

SEQ ID NO: 6439 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDSSGEPPSMTQLLRR

SEQ ID NO: 6440 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDSSSEPPSMTQLLRR

SEQ ID NO: 6441 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDSSAEPPSMTQLLRR

SEQ ID NO: 6442 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDSAGEPPSMTQLLRR

SEQ ID NO: 6443 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDSASEPPSMTQLLRR

SEQ ID NO: 6444 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDSAAEPPSMTQLLRR

SEQ ID NO: 6445 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDAGGEPPSMTQLLRR

SEQ ID NO: 6446 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDAGSEPPSMTQLLRR

SEQ ID NO: 6447 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDAGAEPPSMTQLLRR

SEQ ID NO: 6448 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDASGEPPSMTQLLRR

SEQ ID NO: 6449 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDASSEPPSMTQLLRR

SEQ ID NO: 6450 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDASAEPPSMTQLLRR

SEQ ID NO: 6451 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDAAGEPPSMTQLLRR

SEQ ID NO: 6452 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDAASEPPSMTQLLRR

SEQ ID NO: 6453 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKKGVSNKDIEKETAKDAAAEPPSMTQLLRR

SEQ ID NO: 6454 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDGGGEPPSMTQLLRR

SEQ ID NO: 6455 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDGGSEPPSMTQLLRR

SEQ ID NO: 6456 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDGGAEPPSMTQLLRR

SEQ ID NO: 6457 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDGSGEPPSMTQLLRR

SEQ ID NO: 6458 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDGSSEPPSMTQLLRR

SEQ ID NO: 6459 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDGSAEPPSMTQLLRR

SEQ ID NO: 6460 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDGAGEPPSMTQLLRR

SEQ ID NO: 6461 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDGASEPPSMTQLLRR

SEQ ID NO: 6462 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDGAAEPPSMTQLLRR

SEQ ID NO: 6463 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDSGGEPPSMTQLLRR

SEQ ID NO: 6464 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDSGSEPPSMTQLLRR

SEQ ID NO: 6465 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDSGAEPPSMTQLLRR

SEQ ID NO: 6466 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDSSGEPPSMTQLLRR

SEQ ID NO: 6467 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDSSSEPPSMTQLLRR

SEQ ID NO: 6468 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDSSAEPPSMTQLLRR

SEQ ID NO: 6469 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDSAGEPPSMTQLLRR

SEQ ID NO: 6470 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDSASEPPSMTQLLRR

SEQ ID NO: 6471 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDSAAEPPSMTQLLRR

SEQ ID NO: 6472 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDAGGEPPSMTQLLRR

SEQ ID NO: 6473 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDAGSEPPSMTQLLRR

SEQ ID NO: 6474 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDAGAEPPSMTQLLRR

SEQ ID NO: 6475 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDASGEPPSMTQLLRR

SEQ ID NO: 6476 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDASSEPPSMTQLLRR

SEQ ID NO: 6477 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDASAEPPSMTQLLRR

SEQ ID NO: 6478 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDAAGEPPSMTQLLRR

SEQ ID NO: 6479 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDAASEPPSMTQLLRR

SEQ ID NO: 6480 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKNGVSNKDIEKETAKDAAAEPPSMTQLLRR

SEQ ID NO: 6481 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDGGGEPPSMTQLLRR

SEQ ID NO: 6482 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDGGSEPPSMTQLLRR

SEQ ID NO: 6483 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDGGAEPPSMTQLLRR

SEQ ID NO: 6484 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDGSGEPPSMTQLLRR

SEQ ID NO: 6485 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDGSSEPPSMTQLLRR

SEQ ID NO: 6486 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDGSAEPPSMTQLLRR

SEQ ID NO: 6487 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDGAGEPPSMTQLLRR

SEQ ID NO: 6488 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDGASEPPSMTQLLRR

SEQ ID NO: 6489 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDGAAEPPSMTQLLRR

SEQ ID NO: 6490 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDSGGEPPSMTQLLRR

SEQ ID NO: 6491 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDSGSEPPSMTQLLRR

SEQ ID NO: 6492 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDSGAEPPSMTQLLRR

SEQ ID NO: 6493 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDSSGEPPSMTQLLRR

SEQ ID NO: 6494 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDSSSEPPSMTQLLRR

SEQ ID NO: 6495 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDSSAEPPSMTQLLRR

SEQ ID NO: 6496 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDSAGEPPSMTQLLRR

SEQ ID NO: 6497 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDSASEPPSMTQLLRR

SEQ ID NO: 6498 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDSAAEPPSMTQLLRR

SEQ ID NO: 6499 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDAGGEPPSMTQLLRR

SEQ ID NO: 6500 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDAGSEPPSMTQLLRR

SEQ ID NO: 6501 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDAGAEPPSMTQLLRR

SEQ ID NO: 6502 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDASGEPPSMTQLLRR

SEQ ID NO: 6503 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDASSEPPSMTQLLRR

SEQ ID NO: 6504 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDASAEPPSMTQLLRR

SEQ ID NO: 6505 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDAAGEPPSMTQLLRR

SEQ ID NO: 6506 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDAASEPPSMTQLLRR

SEQ ID NO: 6507 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDGFGLRGLLHLENASYGIEPLQNSSHFEHIIYRMDDVYKEPLKMGVSNKDIEKETAKDAAAEPPSMTQLLRR

SEQ ID NO: 6508 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDGGGEPPSMTQLLRR

SEQ ID NO: 6509 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDGGSEPPSMTQLLRR

SEQ ID NO: 6510 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDGGAEPPSMTQLLRR

SEQ ID NO: 6511 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDGSGEPPSMTQLLRR

SEQ ID NO: 6512 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDGSSEPPSMTQLLRR

SEQ ID NO: 6513 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDGSAEPPSMTQLLRR

SEQ ID NO: 6514 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDGAGEPPSMTQLLRR

SEQ ID NO: 6515 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDGASEPPSMTQLLRR

SEQ ID NO: 6516 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDGAAEPPSMTQLLRR

SEQ ID NO: 6517 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDSGGEPPSMTQLLRR

SEQ ID NO: 6518 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDSGSEPPSMTQLLRR

SEQ ID NO: 6519 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDSGAEPPSMTQLLRR

SEQ ID NO: 6520 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDSSGEPPSMTQLLRR

SEQ ID NO: 6521 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDSSSEPPSMTQLLRR

SEQ ID NO: 6522 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDSSAEPPSMTQLLRR

SEQ ID NO: 6523 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDSAGEPPSMTQLLRR

SEQ ID NO: 6524 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDSASEPPSMTQLLRR

SEQ ID NO: 6525 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDSAAEPPSMTQLLRR

SEQ ID NO: 6526 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDAGGEPPSMTQLLRR

SEQ ID NO: 6527 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDAGSEPPSMTQLLRR

SEQ ID NO: 6528 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDAGAEPPSMTQLLRR

SEQ ID NO: 6529 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDASGEPPSMTQLLRR

SEQ ID NO: 6530 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDASSEPPSMTQLLRR

SEQ ID NO: 6531 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDASAEPPSMTQLLRR

SEQ ID NO: 6532 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDAAGEPPSMTQLLRR

SEQ ID NO: 6533 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDAASEPPSMTQLLRR

SEQ ID NO: 6534 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKCGVSNKDIEKETAKDAAAEPPSMTQLLRR

SEQ ID NO: 6535 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDGGGEPPSMTQLLRR

SEQ ID NO: 6536 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDGGSEPPSMTQLLRR

SEQ ID NO: 6537 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDGGAEPPSMTQLLRR

SEQ ID NO: 6538 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDGSGEPPSMTQLLRR

SEQ ID NO: 6539 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDGSSEPPSMTQLLRR

SEQ ID NO: 6540 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDGSAEPPSMTQLLRR

SEQ ID NO: 6541 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDGAGEPPSMTQLLRR

SEQ ID NO: 6542 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDGASEPPSMTQLLRR

SEQ ID NO: 6543 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDGAAEPPSMTQLLRR

SEQ ID NO: 6544 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDSGGEPPSMTQLLRR

SEQ ID NO: 6545 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDSGSEPPSMTQLLRR

SEQ ID NO: 6546 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDSGAEPPSMTQLLRR

SEQ ID NO: 6547 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDSSGEPPSMTQLLRR

SEQ ID NO: 6548 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDSSSEPPSMTQLLRR

SEQ ID NO: 6549 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDSSAEPPSMTQLLRR

SEQ ID NO: 6550 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDSAGEPPSMTQLLRR

SEQ ID NO: 6551 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDSASEPPSMTQLLRR

SEQ ID NO: 6552 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDSAAEPPSMTQLLRR

SEQ ID NO: 6553 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDAGGEPPSMTQLLRR

SEQ ID NO: 6554 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDAGSEPPSMTQLLRR

SEQ ID NO: 6555 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDAGAEPPSMTQLLRR

SEQ ID NO: 6556 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDASGEPPSMTQLLRR

SEQ ID NO: 6557 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDASSEPPSMTQLLRR

SEQ ID NO: 6558 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDASAEPPSMTQLLRR

SEQ ID NO: 6559 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDAAGEPPSMTQLLRR

SEQ ID NO: 6560 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDAASEPPSMTQLLRR

SEQ ID NO: 6561 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKSGVSNKDIEKETAKDAAAEPPSMTQLLRR

SEQ ID NO: 6562 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDGGGEPPSMTQLLRR

SEQ ID NO: 6563 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDGGSEPPSMTQLLRR

SEQ ID NO: 6564 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDGGAEPPSMTQLLRR

SEQ ID NO: 6565 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDGSGEPPSMTQLLRR

SEQ ID NO: 6566 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDGSSEPPSMTQLLRR

SEQ ID NO: 6567 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDGSAEPPSMTQLLRR

SEQ ID NO: 6568 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDGAGEPPSMTQLLRR

SEQ ID NO: 6569 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDGASEPPSMTQLLRR

SEQ ID NO: 6570 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDGAAEPPSMTQLLRR

SEQ ID NO: 6571 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDSGGEPPSMTQLLRR

SEQ ID NO: 6572 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDSGSEPPSMTQLLRR

SEQ ID NO: 6573 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDSGAEPPSMTQLLRR

SEQ ID NO: 6574 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDSSGEPPSMTQLLRR

SEQ ID NO: 6575 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDSSSEPPSMTQLLRR

SEQ ID NO: 6576 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDSSAEPPSMTQLLRR

SEQ ID NO: 6577 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDSAGEPPSMTQLLRR

SEQ ID NO: 6578 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDSASEPPSMTQLLRR

SEQ ID NO: 6579 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDSAAEPPSMTQLLRR

SEQ ID NO: 6580 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDAGGEPPSMTQLLRR

SEQ ID NO: 6581 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDAGSEPPSMTQLLRR

SEQ ID NO: 6582 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDAGAEPPSMTQLLRR

SEQ ID NO: 6583 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDASGEPPSMTQLLRR

SEQ ID NO: 6584 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDASSEPPSMTQLLRR

SEQ ID NO: 6585 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDASAEPPSMTQLLRR

SEQ ID NO: 6586 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDAAGEPPSMTQLLRR

SEQ ID NO: 6587 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDAASEPPSMTQLLRR

SEQ ID NO: 6588 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKAGVSNKDIEKETAKDAAAEPPSMTQLLRR

SEQ ID NO: 6589 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDGGGEPPSMTQLLRR

SEQ ID NO: 6590 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDGGSEPPSMTQLLRR

SEQ ID NO: 6591 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDGGAEPPSMTQLLRR

SEQ ID NO: 6592 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDGSGEPPSMTQLLRR

SEQ ID NO: 6593 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDGSSEPPSMTQLLRR

SEQ ID NO: 6594 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDGSAEPPSMTQLLRR

SEQ ID NO: 6595 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDGAGEPPSMTQLLRR

SEQ ID NO: 6596 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDGASEPPSMTQLLRR

SEQ ID NO: 6597 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDGAAEPPSMTQLLRR

SEQ ID NO: 6598 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDSGGEPPSMTQLLRR

SEQ ID NO: 6599 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDSGSEPPSMTQLLRR

SEQ ID NO: 6600 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDSGAEPPSMTQLLRR

SEQ ID NO: 6601 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDSSGEPPSMTQLLRR

SEQ ID NO: 6602 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDSSSEPPSMTQLLRR

SEQ ID NO: 6603 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDSSAEPPSMTQLLRR

SEQ ID NO: 6604 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDSAGEPPSMTQLLRR

SEQ ID NO: 6605 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDSASEPPSMTQLLRR

SEQ ID NO: 6606 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDSAAEPPSMTQLLRR

SEQ ID NO: 6607 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDAGGEPPSMTQLLRR

SEQ ID NO: 6608 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDAGSEPPSMTQLLRR

SEQ ID NO: 6609 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDAGAEPPSMTQLLRR

SEQ ID NO: 6610 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDASGEPPSMTQLLRR

SEQ ID NO: 6611 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDASSEPPSMTQLLRR

SEQ ID NO: 6612 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDASAEPPSMTQLLRR

SEQ ID NO: 6613 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDAAGEPPSMTQLLRR

SEQ ID NO: 6614 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDAASEPPSMTQLLRR

SEQ ID NO: 6615 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKGGVSNKDIEKETAKDAAAEPPSMTQLLRR

SEQ ID NO: 6616 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDGGGEPPSMTQLLRR

SEQ ID NO: 6617 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDGGSEPPSMTQLLRR

SEQ ID NO: 6618 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDGGAEPPSMTQLLRR

SEQ ID NO: 6619 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDGSGEPPSMTQLLRR

SEQ ID NO: 6620 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDGSSEPPSMTQLLRR

SEQ ID NO: 6621 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDGSAEPPSMTQLLRR

SEQ ID NO: 6622 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDGAGEPPSMTQLLRR

SEQ ID NO: 6623 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDGASEPPSMTQLLRR

SEQ ID NO: 6624 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDGAAEPPSMTQLLRR

SEQ ID NO: 6625 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDSGGEPPSMTQLLRR

SEQ ID NO: 6626 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDSGSEPPSMTQLLRR

SEQ ID NO: 6627 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDSGAEPPSMTQLLRR

SEQ ID NO: 6628 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDSSGEPPSMTQLLRR

SEQ ID NO: 6629 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDSSSEPPSMTQLLRR

SEQ ID NO: 6630 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDSSAEPPSMTQLLRR

SEQ ID NO: 6631 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDSAGEPPSMTQLLRR

SEQ ID NO: 6632 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDSASEPPSMTQLLRR

SEQ ID NO: 6633 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDSAAEPPSMTQLLRR

SEQ ID NO: 6634 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDAGGEPPSMTQLLRR

SEQ ID NO: 6635 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDAGSEPPSMTQLLRR

SEQ ID NO: 6636 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDAGAEPPSMTQLLRR

SEQ ID NO: 6637 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDASGEPPSMTQLLRR

SEQ ID NO: 6638 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDASSEPPSMTQLLRR

SEQ ID NO: 6639 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDASAEPPSMTQLLRR

SEQ ID NO: 6640 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDAAGEPPSMTQLLRR

SEQ ID NO: 6641 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDAASEPPSMTQLLRR

SEQ ID NO: 6642 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKDGVSNKDIEKETAKDAAAEPPSMTQLLRR

SEQ ID NO: 6643 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDGGGEPPSMTQLLRR

SEQ ID NO: 6644 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDGGSEPPSMTQLLRR

SEQ ID NO: 6645 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDGGAEPPSMTQLLRR

SEQ ID NO: 6646 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDGSGEPPSMTQLLRR

SEQ ID NO: 6647 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDGSSEPPSMTQLLRR

SEQ ID NO: 6648 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDGSAEPPSMTQLLRR

SEQ ID NO: 6649 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDGAGEPPSMTQLLRR

SEQ ID NO: 6650 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDGASEPPSMTQLLRR

SEQ ID NO: 6651 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDGAAEPPSMTQLLRR

SEQ ID NO: 6652 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDSGGEPPSMTQLLRR

SEQ ID NO: 6653 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDSGSEPPSMTQLLRR

SEQ ID NO: 6654 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDSGAEPPSMTQLLRR

SEQ ID NO: 6655 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDSSGEPPSMTQLLRR

SEQ ID NO: 6656 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDSSSEPPSMTQLLRR

SEQ ID NO: 6657 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDSSAEPPSMTQLLRR

SEQ ID NO: 6658 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDSAGEPPSMTQLLRR

SEQ ID NO: 6659 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDSASEPPSMTQLLRR

SEQ ID NO: 6660 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDSAAEPPSMTQLLRR

SEQ ID NO: 6661 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDAGGEPPSMTQLLRR

SEQ ID NO: 6662 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDAGSEPPSMTQLLRR

SEQ ID NO: 6663 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDAGAEPPSMTQLLRR

SEQ ID NO: 6664 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDASGEPPSMTQLLRR

SEQ ID NO: 6665 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDASSEPPSMTQLLRR

SEQ ID NO: 6666 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDASAEPPSMTQLLRR

SEQ ID NO: 6667 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDAAGEPPSMTQLLRR

SEQ ID NO: 6668 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDAASEPPSMTQLLRR

SEQ ID NO: 6669 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKHGVSNKDIEKETAKDAAAEPPSMTQLLRR

SEQ ID NO: 6670 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDGGGEPPSMTQLLRR

SEQ ID NO: 6671 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDGGSEPPSMTQLLRR

SEQ ID NO: 6672 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDGGAEPPSMTQLLRR

SEQ ID NO: 6673 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDGSGEPPSMTQLLRR

SEQ ID NO: 6674 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDGSSEPPSMTQLLRR

SEQ ID NO: 6675 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDGSAEPPSMTQLLRR

SEQ ID NO: 6676 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDGAGEPPSMTQLLRR

SEQ ID NO: 6677 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDGASEPPSMTQLLRR

SEQ ID NO: 6678 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDGAAEPPSMTQLLRR

SEQ ID NO: 6679 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDSGGEPPSMTQLLRR

SEQ ID NO: 6680 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDSGSEPPSMTQLLRR

SEQ ID NO: 6681 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDSGAEPPSMTQLLRR

SEQ ID NO: 6682 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDSSGEPPSMTQLLRR

SEQ ID NO: 6683 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDSSSEPPSMTQLLRR

SEQ ID NO: 6684 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDSSAEPPSMTQLLRR

SEQ ID NO: 6685 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDSAGEPPSMTQLLRR

SEQ ID NO: 6686 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDSASEPPSMTQLLRR

SEQ ID NO: 6687 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDSAAEPPSMTQLLRR

SEQ ID NO: 6688 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDAGGEPPSMTQLLRR

SEQ ID NO: 6689 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDAGSEPPSMTQLLRR

SEQ ID NO: 6690 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDAGAEPPSMTQLLRR

SEQ ID NO: 6691 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDASGEPPSMTQLLRR

SEQ ID NO: 6692 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDASSEPPSMTQLLRR

SEQ ID NO: 6693 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDASAEPPSMTQLLRR

SEQ ID NO: 6694 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDAAGEPPSMTQLLRR

SEQ ID NO: 6695 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDAASEPPSMTQLLRR

SEQ ID NO: 6696 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKYGVSNKDIEKETAKDAAAEPPSMTQLLRR

SEQ ID NO: 6697 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDGGGEPPSMTQLLRR

SEQ ID NO: 6698 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDGGSEPPSMTQLLRR

SEQ ID NO: 6699 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDGGAEPPSMTQLLRR

SEQ ID NO: 6700 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDGSGEPPSMTQLLRR

SEQ ID NO: 6701 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDGSSEPPSMTQLLRR

SEQ ID NO: 6702 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDGSAEPPSMTQLLRR

SEQ ID NO: 6703 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDGAGEPPSMTQLLRR

SEQ ID NO: 6704 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDGASEPPSMTQLLRR

SEQ ID NO: 6705 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDGAAEPPSMTQLLRR

SEQ ID NO: 6706 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDSGGEPPSMTQLLRR

SEQ ID NO: 6707 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDSGSEPPSMTQLLRR

SEQ ID NO: 6708 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDSGAEPPSMTQLLRR

SEQ ID NO: 6709 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDSSGEPPSMTQLLRR

SEQ ID NO: 6710 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDSSSEPPSMTQLLRR

SEQ ID NO: 6711 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDSSAEPPSMTQLLRR

SEQ ID NO: 6712 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDSAGEPPSMTQLLRR

SEQ ID NO: 6713 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDSASEPPSMTQLLRR

SEQ ID NO: 6714 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDSAAEPPSMTQLLRR

SEQ ID NO: 6715 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDAGGEPPSMTQLLRR

SEQ ID NO: 6716 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDAGSEPPSMTQLLRR

SEQ ID NO: 6717 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDAGAEPPSMTQLLRR

SEQ ID NO: 6718 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDASGEPPSMTQLLRR

SEQ ID NO: 6719 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDASSEPPSMTQLLRR

SEQ ID NO: 6720 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDASAEPPSMTQLLRR

SEQ ID NO: 6721 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDAAGEPPSMTQLLRR

SEQ ID NO: 6722 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDAASEPPSMTQLLRR

SEQ ID NO: 6723 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKKGVSNKDIEKETAKDAAAEPPSMTQLLRR

SEQ ID NO: 6724 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDGGGEPPSMTQLLRR

SEQ ID NO: 6725 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDGGSEPPSMTQLLRR

SEQ ID NO: 6726 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDGGAEPPSMTQLLRR

SEQ ID NO: 6727 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDGSGEPPSMTQLLRR

SEQ ID NO: 6728 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDGSSEPPSMTQLLRR

SEQ ID NO: 6729 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDGSAEPPSMTQLLRR

SEQ ID NO: 6730 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDGAGEPPSMTQLLRR

SEQ ID NO: 6731 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDGASEPPSMTQLLRR

SEQ ID NO: 6732 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDGAAEPPSMTQLLRR

SEQ ID NO: 6733 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDSGGEPPSMTQLLRR

SEQ ID NO: 6734 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDSGSEPPSMTQLLRR

SEQ ID NO: 6735 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDSGAEPPSMTQLLRR

SEQ ID NO: 6736 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDSSGEPPSMTQLLRR

SEQ ID NO: 6737 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDSSSEPPSMTQLLRR

SEQ ID NO: 6738 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDSSAEPPSMTQLLRR

SEQ ID NO: 6739 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDSAGEPPSMTQLLRR

SEQ ID NO: 6740 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDSASEPPSMTQLLRR

SEQ ID NO: 6741 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDSAAEPPSMTQLLRR

SEQ ID NO: 6742 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDAGGEPPSMTQLLRR

SEQ ID NO: 6743 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDAGSEPPSMTQLLRR

SEQ ID NO: 6744 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDAGAEPPSMTQLLRR

SEQ ID NO: 6745 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDASGEPPSMTQLLRR

SEQ ID NO: 6746 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDASSEPPSMTQLLRR

SEQ ID NO: 6747 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDASAEPPSMTQLLRR

SEQ ID NO: 6748 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDAAGEPPSMTQLLRR

SEQ ID NO: 6749 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDAASEPPSMTQLLRR

SEQ ID NO: 6750 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKNGVSNKDIEKETAKDAAAEPPSMTQLLRR

SEQ ID NO: 6751 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDGGGEPPSMTQLLRR

SEQ ID NO: 6752 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDGGSEPPSMTQLLRR

SEQ ID NO: 6753 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDGGAEPPSMTQLLRR

SEQ ID NO: 6754 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDGSGEPPSMTQLLRR

SEQ ID NO: 6755 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDGSSEPPSMTQLLRR

SEQ ID NO: 6756 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDGSAEPPSMTQLLRR

SEQ ID NO: 6757 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDGAGEPPSMTQLLRR

SEQ ID NO: 6758 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDGASEPPSMTQLLRR

SEQ ID NO: 6759 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDGAAEPPSMTQLLRR

SEQ ID NO: 6760 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDSGGEPPSMTQLLRR

SEQ ID NO: 6761 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDSGSEPPSMTQLLRR

SEQ ID NO: 6762 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDSGAEPPSMTQLLRR

SEQ ID NO: 6763 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDSSGEPPSMTQLLRR

SEQ ID NO: 6764 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDSSSEPPSMTQLLRR

SEQ ID NO: 6765 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDSSAEPPSMTQLLRR

SEQ ID NO: 6766 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDSAGEPPSMTQLLRR

SEQ ID NO: 6767 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDSASEPPSMTQLLRR

SEQ ID NO: 6768 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDSAAEPPSMTQLLRR

SEQ ID NO: 6769 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDAGGEPPSMTQLLRR

SEQ ID NO: 6770 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDAGSEPPSMTQLLRR

SEQ ID NO: 6771 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDAGAEPPSMTQLLRR

SEQ ID NO: 6772 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDASGEPPSMTQLLRR

SEQ ID NO: 6773 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDASSEPPSMTQLLRR

SEQ ID NO: 6774 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDASAEPPSMTQLLRR

SEQ ID NO: 6775 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDAAGEPPSMTQLLRR

SEQ ID NO: 6776 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDAASEPPSMTQLLRR

SEQ ID NO: 6777 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDDFGLRGLLHLENASYGIEPLQNSSHFEHIIYRMDDVYKEPLKMGVSNKDIEKETAKDAAAEPPSMTQLLRR

SEQ ID NO: 6778 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDGGGEPPSMTQLLRR

SEQ ID NO: 6779 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDGGSEPPSMTQLLRR

SEQ ID NO: 6780 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDGGAEPPSMTQLLRR

SEQ ID NO: 6781 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDGSGEPPSMTQLLRR

SEQ ID NO: 6782 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDGSSEPPSMTQLLRR

SEQ ID NO: 6783 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDGSAEPPSMTQLLRR

SEQ ID NO: 6784 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDGAGEPPSMTQLLRR

SEQ ID NO: 6785 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDGASEPPSMTQLLRR

SEQ ID NO: 6786 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDGAAEPPSMTQLLRR

SEQ ID NO: 6787 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDSGGEPPSMTQLLRR

SEQ ID NO: 6788 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDSGSEPPSMTQLLRR

SEQ ID NO: 6789 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDSGAEPPSMTQLLRR

SEQ ID NO: 6790 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDSSGEPPSMTQLLRR

SEQ ID NO: 6791 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDSSSEPPSMTQLLRR

SEQ ID NO: 6792 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDSSAEPPSMTQLLRR

SEQ ID NO: 6793 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDSAGEPPSMTQLLRR

SEQ ID NO: 6794 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDSASEPPSMTQLLRR

SEQ ID NO: 6795 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDSAAEPPSMTQLLRR

SEQ ID NO: 6796 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDAGGEPPSMTQLLRR

SEQ ID NO: 6797 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDAGSEPPSMTQLLRR

SEQ ID NO: 6798 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDAGAEPPSMTQLLRR

SEQ ID NO: 6799 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDASGEPPSMTQLLRR

SEQ ID NO: 6800 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDASSEPPSMTQLLRR

SEQ ID NO: 6801 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDASAEPPSMTQLLRR

SEQ ID NO: 6802 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDAAGEPPSMTQLLRR

SEQ ID NO: 6803 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDAASEPPSMTQLLRR

SEQ ID NO: 6804 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKCGVSNKDIEKETAKDAAAEPPSMTQLLRR

SEQ ID NO: 6805 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDGGGEPPSMTQLLRR

SEQ ID NO: 6806 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDGGSEPPSMTQLLRR

SEQ ID NO: 6807 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDGGAEPPSMTQLLRR

SEQ ID NO: 6808 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDGSGEPPSMTQLLRR

SEQ ID NO: 6809 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDGSSEPPSMTQLLRR

SEQ ID NO: 6810 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDGSAEPPSMTQLLRR

SEQ ID NO: 6811 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDGAGEPPSMTQLLRR

SEQ ID NO: 6812 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDGASEPPSMTQLLRR

SEQ ID NO: 6813 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDGAAEPPSMTQLLRR

SEQ ID NO: 6814 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDSGGEPPSMTQLLRR

SEQ ID NO: 6815 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDSGSEPPSMTQLLRR

SEQ ID NO: 6816 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDSGAEPPSMTQLLRR

SEQ ID NO: 6817 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDSSGEPPSMTQLLRR

SEQ ID NO: 6818 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDSSSEPPSMTQLLRR

SEQ ID NO: 6819 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDSSAEPPSMTQLLRR

SEQ ID NO: 6820 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDSAGEPPSMTQLLRR

SEQ ID NO: 6821 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDSASEPPSMTQLLRR

SEQ ID NO: 6822 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDSAAEPPSMTQLLRR

SEQ ID NO: 6823 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDAGGEPPSMTQLLRR

SEQ ID NO: 6824 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDAGSEPPSMTQLLRR

SEQ ID NO: 6825 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDAGAEPPSMTQLLRR

SEQ ID NO: 6826 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDASGEPPSMTQLLRR

SEQ ID NO: 6827 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDASSEPPSMTQLLRR

SEQ ID NO: 6828 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDASAEPPSMTQLLRR

SEQ ID NO: 6829 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDAAGEPPSMTQLLRR

SEQ ID NO: 6830 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDAASEPPSMTQLLRR

SEQ ID NO: 6831 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKSGVSNKDIEKETAKDAAAEPPSMTQLLRR

SEQ ID NO: 6832 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDGGGEPPSMTQLLRR

SEQ ID NO: 6833 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDGGSEPPSMTQLLRR

SEQ ID NO: 6834 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDGGAEPPSMTQLLRR

SEQ ID NO: 6835 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDGSGEPPSMTQLLRR

SEQ ID NO: 6836 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDGSSEPPSMTQLLRR

SEQ ID NO: 6837 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDGSAEPPSMTQLLRR

SEQ ID NO: 6838 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDGAGEPPSMTQLLRR

SEQ ID NO: 6839 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDGASEPPSMTQLLRR

SEQ ID NO: 6840 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDGAAEPPSMTQLLRR

SEQ ID NO: 6841 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDSGGEPPSMTQLLRR

SEQ ID NO: 6842 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDSGSEPPSMTQLLRR

SEQ ID NO: 6843 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDSGAEPPSMTQLLRR

SEQ ID NO: 6844 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDSSGEPPSMTQLLRR

SEQ ID NO: 6845 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDSSSEPPSMTQLLRR

SEQ ID NO: 6846 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDSSAEPPSMTQLLRR

SEQ ID NO: 6847 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDSAGEPPSMTQLLRR

SEQ ID NO: 6848 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDSASEPPSMTQLLRR

SEQ ID NO: 6849 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDSAAEPPSMTQLLRR

SEQ ID NO: 6850 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDAGGEPPSMTQLLRR

SEQ ID NO: 6851 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDAGSEPPSMTQLLRR

SEQ ID NO: 6852 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDAGAEPPSMTQLLRR

SEQ ID NO: 6853 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDASGEPPSMTQLLRR

SEQ ID NO: 6854 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDASSEPPSMTQLLRR

SEQ ID NO: 6855 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDASAEPPSMTQLLRR

SEQ ID NO: 6856 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDAAGEPPSMTQLLRR

SEQ ID NO: 6857 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDAASEPPSMTQLLRR

SEQ ID NO: 6858 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKAGVSNKDIEKETAKDAAAEPPSMTQLLRR

SEQ ID NO: 6859 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDGGGEPPSMTQLLRR

SEQ ID NO: 6860 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDGGSEPPSMTQLLRR

SEQ ID NO: 6861 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDGGAEPPSMTQLLRR

SEQ ID NO: 6862 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDGSGEPPSMTQLLRR

SEQ ID NO: 6863 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDGSSEPPSMTQLLRR

SEQ ID NO: 6864 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDGSAEPPSMTQLLRR

SEQ ID NO: 6865 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDGAGEPPSMTQLLRR

SEQ ID NO: 6866 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDGASEPPSMTQLLRR

SEQ ID NO: 6867 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDGAAEPPSMTQLLRR

SEQ ID NO: 6868 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDSGGEPPSMTQLLRR

SEQ ID NO: 6869 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDSGSEPPSMTQLLRR

SEQ ID NO: 6870 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDSGAEPPSMTQLLRR

SEQ ID NO: 6871 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDSSGEPPSMTQLLRR

SEQ ID NO: 6872 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDSSSEPPSMTQLLRR

SEQ ID NO: 6873 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDSSAEPPSMTQLLRR

SEQ ID NO: 6874 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDSAGEPPSMTQLLRR

SEQ ID NO: 6875 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDSASEPPSMTQLLRR

SEQ ID NO: 6876 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDSAAEPPSMTQLLRR

SEQ ID NO: 6877 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDAGGEPPSMTQLLRR

SEQ ID NO: 6878 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDAGSEPPSMTQLLRR

SEQ ID NO: 6879 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDAGAEPPSMTQLLRR

SEQ ID NO: 6880 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDASGEPPSMTQLLRR

SEQ ID NO: 6881 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDASSEPPSMTQLLRR

SEQ ID NO: 6882 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDASAEPPSMTQLLRR

SEQ ID NO: 6883 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDAAGEPPSMTQLLRR

SEQ ID NO: 6884 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDAASEPPSMTQLLRR

SEQ ID NO: 6885 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKGGVSNKDIEKETAKDAAAEPPSMTQLLRR

SEQ ID NO: 6886 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDGGGEPPSMTQLLRR

SEQ ID NO: 6887 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDGGSEPPSMTQLLRR

SEQ ID NO: 6888 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDGGAEPPSMTQLLRR

SEQ ID NO: 6889 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDGSGEPPSMTQLLRR

SEQ ID NO: 6890 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDGSSEPPSMTQLLRR

SEQ ID NO: 6891 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDGSAEPPSMTQLLRR

SEQ ID NO: 6892 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDGAGEPPSMTQLLRR

SEQ ID NO: 6893 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDGASEPPSMTQLLRR

SEQ ID NO: 6894 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDGAAEPPSMTQLLRR

SEQ ID NO: 6895 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDSGGEPPSMTQLLRR

SEQ ID NO: 6896 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDSGSEPPSMTQLLRR

SEQ ID NO: 6897 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDSGAEPPSMTQLLRR

SEQ ID NO: 6898 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDSSGEPPSMTQLLRR

SEQ ID NO: 6899 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDSSSEPPSMTQLLRR

SEQ ID NO: 6900 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDSSAEPPSMTQLLRR

SEQ ID NO: 6901 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDSAGEPPSMTQLLRR

SEQ ID NO: 6902 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDSASEPPSMTQLLRR

SEQ ID NO: 6903 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDSAAEPPSMTQLLRR

SEQ ID NO: 6904 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDAGGEPPSMTQLLRR

SEQ ID NO: 6905 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDAGSEPPSMTQLLRR

SEQ ID NO: 6906 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDAGAEPPSMTQLLRR

SEQ ID NO: 6907 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDASGEPPSMTQLLRR

SEQ ID NO: 6908 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDASSEPPSMTQLLRR

SEQ ID NO: 6909 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDASAEPPSMTQLLRR

SEQ ID NO: 6910 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDAAGEPPSMTQLLRR

SEQ ID NO: 6911 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDAASEPPSMTQLLRR

SEQ ID NO: 6912 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKDGVSNKDIEKETAKDAAAEPPSMTQLLRR

SEQ ID NO: 6913 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDGGGEPPSMTQLLRR

SEQ ID NO: 6914 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDGGSEPPSMTQLLRR

SEQ ID NO: 6915 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDGGAEPPSMTQLLRR

SEQ ID NO: 6916 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDGSGEPPSMTQLLRR

SEQ ID NO: 6917 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDGSSEPPSMTQLLRR

SEQ ID NO: 6918 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDGSAEPPSMTQLLRR

SEQ ID NO: 6919 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDGAGEPPSMTQLLRR

SEQ ID NO: 6920 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDGASEPPSMTQLLRR

SEQ ID NO: 6921 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDGAAEPPSMTQLLRR

SEQ ID NO: 6922 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDSGGEPPSMTQLLRR

SEQ ID NO: 6923 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDSGSEPPSMTQLLRR

SEQ ID NO: 6924 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDSGAEPPSMTQLLRR

SEQ ID NO: 6925 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDSSGEPPSMTQLLRR

SEQ ID NO: 6926 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDSSSEPPSMTQLLRR

SEQ ID NO: 6927 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDSSAEPPSMTQLLRR

SEQ ID NO: 6928 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDSAGEPPSMTQLLRR

SEQ ID NO: 6929 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDSASEPPSMTQLLRR

SEQ ID NO: 6930 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDSAAEPPSMTQLLRR

SEQ ID NO: 6931 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDAGGEPPSMTQLLRR

SEQ ID NO: 6932 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDAGSEPPSMTQLLRR

SEQ ID NO: 6933 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDAGAEPPSMTQLLRR

SEQ ID NO: 6934 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDASGEPPSMTQLLRR

SEQ ID NO: 6935 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDASSEPPSMTQLLRR

SEQ ID NO: 6936 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDASAEPPSMTQLLRR

SEQ ID NO: 6937 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDAAGEPPSMTQLLRR

SEQ ID NO: 6938 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDAASEPPSMTQLLRR

SEQ ID NO: 6939 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKHGVSNKDIEKETAKDAAAEPPSMTQLLRR

SEQ ID NO: 6940 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDGGGEPPSMTQLLRR

SEQ ID NO: 6941 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDGGSEPPSMTQLLRR

SEQ ID NO: 6942 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDGGAEPPSMTQLLRR

SEQ ID NO: 6943 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDGSGEPPSMTQLLRR

SEQ ID NO: 6944 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDGSSEPPSMTQLLRR

SEQ ID NO: 6945 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDGSAEPPSMTQLLRR

SEQ ID NO: 6946 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDGAGEPPSMTQLLRR

SEQ ID NO: 6947 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDGASEPPSMTQLLRR

SEQ ID NO: 6948 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDGAAEPPSMTQLLRR

SEQ ID NO: 6949 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDSGGEPPSMTQLLRR

SEQ ID NO: 6950 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDSGSEPPSMTQLLRR

SEQ ID NO: 6951 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDSGAEPPSMTQLLRR

SEQ ID NO: 6952 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDSSGEPPSMTQLLRR

SEQ ID NO: 6953 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDSSSEPPSMTQLLRR

SEQ ID NO: 6954 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDSSAEPPSMTQLLRR

SEQ ID NO: 6955 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDSAGEPPSMTQLLRR

SEQ ID NO: 6956 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDSASEPPSMTQLLRR

SEQ ID NO: 6957 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDSAAEPPSMTQLLRR

SEQ ID NO: 6958 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDAGGEPPSMTQLLRR

SEQ ID NO: 6959 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDAGSEPPSMTQLLRR

SEQ ID NO: 6960 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDAGAEPPSMTQLLRR

SEQ ID NO: 6961 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDASGEPPSMTQLLRR

SEQ ID NO: 6962 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDASSEPPSMTQLLRR

SEQ ID NO: 6963 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDASAEPPSMTQLLRR

SEQ ID NO: 6964 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDAAGEPPSMTQLLRR

SEQ ID NO: 6965 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDAASEPPSMTQLLRR

SEQ ID NO: 6966 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKYGVSNKDIEKETAKDAAAEPPSMTQLLRR

SEQ ID NO: 6967 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDGGGEPPSMTQLLRR

SEQ ID NO: 6968 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDGGSEPPSMTQLLRR

SEQ ID NO: 6969 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDGGAEPPSMTQLLRR

SEQ ID NO: 6970 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDGSGEPPSMTQLLRR

SEQ ID NO: 6971 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDGSSEPPSMTQLLRR

SEQ ID NO: 6972 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDGSAEPPSMTQLLRR

SEQ ID NO: 6973 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDGAGEPPSMTQLLRR

SEQ ID NO: 6974 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDGASEPPSMTQLLRR

SEQ ID NO: 6975 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDGAAEPPSMTQLLRR

SEQ ID NO: 6976 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDSGGEPPSMTQLLRR

SEQ ID NO: 6977 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDSGSEPPSMTQLLRR

SEQ ID NO: 6978 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDSGAEPPSMTQLLRR

SEQ ID NO: 6979 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDSSGEPPSMTQLLRR

SEQ ID NO: 6980 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDSSSEPPSMTQLLRR

SEQ ID NO: 6981 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDSSAEPPSMTQLLRR

SEQ ID NO: 6982 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDSAGEPPSMTQLLRR

SEQ ID NO: 6983 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDSASEPPSMTQLLRR

SEQ ID NO: 6984 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDSAAEPPSMTQLLRR

SEQ ID NO: 6985 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDAGGEPPSMTQLLRR

SEQ ID NO: 6986 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDAGSEPPSMTQLLRR

SEQ ID NO: 6987 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDAGAEPPSMTQLLRR

SEQ ID NO: 6988 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDASGEPPSMTQLLRR

SEQ ID NO: 6989 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDASSEPPSMTQLLRR

SEQ ID NO: 6990 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDASAEPPSMTQLLRR

SEQ ID NO: 6991 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDAAGEPPSMTQLLRR

SEQ ID NO: 6992 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDAASEPPSMTQLLRR

SEQ ID NO: 6993 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKKGVSNKDIEKETAKDAAAEPPSMTQLLRR

SEQ ID NO: 6994 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDGGGEPPSMTQLLRR

SEQ ID NO: 6995 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDGGSEPPSMTQLLRR

SEQ ID NO: 6996 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDGGAEPPSMTQLLRR

SEQ ID NO: 6997 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDGSGEPPSMTQLLRR

SEQ ID NO: 6998 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDGSSEPPSMTQLLRR

SEQ ID NO: 6999 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDGSAEPPSMTQLLRR

SEQ ID NO: 7000 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDGAGEPPSMTQLLRR

SEQ ID NO: 7001 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDGASEPPSMTQLLRR

SEQ ID NO: 7002 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDGAAEPPSMTQLLRR

SEQ ID NO: 7003 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDSGGEPPSMTQLLRR

SEQ ID NO: 7004 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDSGSEPPSMTQLLRR

SEQ ID NO: 7005 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDSGAEPPSMTQLLRR

SEQ ID NO: 7006 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDSSGEPPSMTQLLRR

SEQ ID NO: 7007 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDSSSEPPSMTQLLRR

SEQ ID NO: 7008 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDSSAEPPSMTQLLRR

SEQ ID NO: 7009 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDSAGEPPSMTQLLRR

SEQ ID NO: 7010 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDSASEPPSMTQLLRR

SEQ ID NO: 7011 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDSAAEPPSMTQLLRR

SEQ ID NO: 7012 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDAGGEPPSMTQLLRR

SEQ ID NO: 7013 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDAGSEPPSMTQLLRR

SEQ ID NO: 7014 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDAGAEPPSMTQLLRR

SEQ ID NO: 7015 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDASGEPPSMTQLLRR

SEQ ID NO: 7016 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDASSEPPSMTQLLRR

SEQ ID NO: 7017 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDASAEPPSMTQLLRR

SEQ ID NO: 7018 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDAAGEPPSMTQLLRR

SEQ ID NO: 7019 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDAASEPPSMTQLLRR

SEQ ID NO: 7020 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKNGVSNKDIEKETAKDAAAEPPSMTQLLRR

SEQ ID NO: 7021 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDGGGEPPSMTQLLRR

SEQ ID NO: 7022 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDGGSEPPSMTQLLRR

SEQ ID NO: 7023 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDGGAEPPSMTQLLRR

SEQ ID NO: 7024 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDGSGEPPSMTQLLRR

SEQ ID NO: 7025 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDGSSEPPSMTQLLRR

SEQ ID NO: 7026 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDGSAEPPSMTQLLRR

SEQ ID NO: 7027 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDGAGEPPSMTQLLRR

SEQ ID NO: 7028 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDGASEPPSMTQLLRR

SEQ ID NO: 7029 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDGAAEPPSMTQLLRR

SEQ ID NO: 7030 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDSGGEPPSMTQLLRR

SEQ ID NO: 7031 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDSGSEPPSMTQLLRR

SEQ ID NO: 7032 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDSGAEPPSMTQLLRR

SEQ ID NO: 7033 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDSSGEPPSMTQLLRR

SEQ ID NO: 7034 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDSSSEPPSMTQLLRR

SEQ ID NO: 7035 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDSSAEPPSMTQLLRR

SEQ ID NO: 7036 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDSAGEPPSMTQLLRR

SEQ ID NO: 7037 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDSASEPPSMTQLLRR

SEQ ID NO: 7038 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDSAAEPPSMTQLLRR

SEQ ID NO: 7039 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDAGGEPPSMTQLLRR

SEQ ID NO: 7040 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDAGSEPPSMTQLLRR

SEQ ID NO: 7041 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDAGAEPPSMTQLLRR

SEQ ID NO: 7042 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDASGEPPSMTQLLRR

SEQ ID NO: 7043 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDASSEPPSMTQLLRR

SEQ ID NO: 7044 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDASAEPPSMTQLLRR

SEQ ID NO: 7045 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDAAGEPPSMTQLLRR

SEQ ID NO: 7046 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDAASEPPSMTQLLRR

SEQ ID NO: 7047 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDHFGLRGLLHLENASYGIEPLQNSSHFEHIIYRMDDVYKEPLKMGVSNKDIEKETAKDAAAEPPSMTQLLRR

SEQ ID NO: 7048 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDGGGEPPSMTQLLRR

SEQ ID NO: 7049 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDGGSEPPSMTQLLRR

SEQ ID NO: 7050 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDGGAEPPSMTQLLRR

SEQ ID NO: 7051 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDGSGEPPSMTQLLRR

SEQ ID NO: 7052 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDGSSEPPSMTQLLRR

SEQ ID NO: 7053 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDGSAEPPSMTQLLRR

SEQ ID NO: 7054 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDGAGEPPSMTQLLRR

SEQ ID NO: 7055 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDGASEPPSMTQLLRR

SEQ ID NO: 7056 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDGAAEPPSMTQLLRR

SEQ ID NO: 7057 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDSGGEPPSMTQLLRR

SEQ ID NO: 7058 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDSGSEPPSMTQLLRR

SEQ ID NO: 7059 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDSGAEPPSMTQLLRR

SEQ ID NO: 7060 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDSSGEPPSMTQLLRR

SEQ ID NO: 7061 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDSSSEPPSMTQLLRR

SEQ ID NO: 7062 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDSSAEPPSMTQLLRR

SEQ ID NO: 7063 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDSAGEPPSMTQLLRR

SEQ ID NO: 7064 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDSASEPPSMTQLLRR

SEQ ID NO: 7065 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDSAAEPPSMTQLLRR

SEQ ID NO: 7066 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDAGGEPPSMTQLLRR

SEQ ID NO: 7067 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDAGSEPPSMTQLLRR

SEQ ID NO: 7068 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDAGAEPPSMTQLLRR

SEQ ID NO: 7069 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDASGEPPSMTQLLRR

SEQ ID NO: 7070 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDASSEPPSMTQLLRR

SEQ ID NO: 7071 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDASAEPPSMTQLLRR

SEQ ID NO: 7072 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDAAGEPPSMTQLLRR

SEQ ID NO: 7073 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDAASEPPSMTQLLRR

SEQ ID NO: 7074 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKCGVSNKDIEKETAKDAAAEPPSMTQLLRR

SEQ ID NO: 7075 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDGGGEPPSMTQLLRR

SEQ ID NO: 7076 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDGGSEPPSMTQLLRR

SEQ ID NO: 7077 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDGGAEPPSMTQLLRR

SEQ ID NO: 7078 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDGSGEPPSMTQLLRR

SEQ ID NO: 7079 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDGSSEPPSMTQLLRR

SEQ ID NO: 7080 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDGSAEPPSMTQLLRR

SEQ ID NO: 7081 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDGAGEPPSMTQLLRR

SEQ ID NO: 7082 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDGASEPPSMTQLLRR

SEQ ID NO: 7083 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDGAAEPPSMTQLLRR

SEQ ID NO: 7084 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDSGGEPPSMTQLLRR

SEQ ID NO: 7085 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDSGSEPPSMTQLLRR

SEQ ID NO: 7086 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDSGAEPPSMTQLLRR

SEQ ID NO: 7087 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDSSGEPPSMTQLLRR

SEQ ID NO: 7088 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDSSSEPPSMTQLLRR

SEQ ID NO: 7089 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDSSAEPPSMTQLLRR

SEQ ID NO: 7090 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDSAGEPPSMTQLLRR

SEQ ID NO: 7091 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDSASEPPSMTQLLRR

SEQ ID NO: 7092 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDSAAEPPSMTQLLRR

SEQ ID NO: 7093 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDAGGEPPSMTQLLRR

SEQ ID NO: 7094 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDAGSEPPSMTQLLRR

SEQ ID NO: 7095 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDAGAEPPSMTQLLRR

SEQ ID NO: 7096 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDASGEPPSMTQLLRR

SEQ ID NO: 7097 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDASSEPPSMTQLLRR

SEQ ID NO: 7098 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDASAEPPSMTQLLRR

SEQ ID NO: 7099 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDAAGEPPSMTQLLRR

SEQ ID NO: 7100 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDAASEPPSMTQLLRR

SEQ ID NO: 7101 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKSGVSNKDIEKETAKDAAAEPPSMTQLLRR

SEQ ID NO: 7102 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDGGGEPPSMTQLLRR

SEQ ID NO: 7103 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDGGSEPPSMTQLLRR

SEQ ID NO: 7104 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDGGAEPPSMTQLLRR

SEQ ID NO: 7105 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDGSGEPPSMTQLLRR

SEQ ID NO: 7106 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDGSSEPPSMTQLLRR

SEQ ID NO: 7107 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDGSAEPPSMTQLLRR

SEQ ID NO: 7108 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDGAGEPPSMTQLLRR

SEQ ID NO: 7109 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDGASEPPSMTQLLRR

SEQ ID NO: 7110 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDGAAEPPSMTQLLRR

SEQ ID NO: 7111 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDSGGEPPSMTQLLRR

SEQ ID NO: 7112 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDSGSEPPSMTQLLRR

SEQ ID NO: 7113 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDSGAEPPSMTQLLRR

SEQ ID NO: 7114 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDSSGEPPSMTQLLRR

SEQ ID NO: 7115 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDSSSEPPSMTQLLRR

SEQ ID NO: 7116 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDSSAEPPSMTQLLRR

SEQ ID NO: 7117 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDSAGEPPSMTQLLRR

SEQ ID NO: 7118 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDSASEPPSMTQLLRR

SEQ ID NO: 7119 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDSAAEPPSMTQLLRR

SEQ ID NO: 7120 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDAGGEPPSMTQLLRR

SEQ ID NO: 7121 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDAGSEPPSMTQLLRR

SEQ ID NO: 7122 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDAGAEPPSMTQLLRR

SEQ ID NO: 7123 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDASGEPPSMTQLLRR

SEQ ID NO: 7124 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDASSEPPSMTQLLRR

SEQ ID NO: 7125 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDASAEPPSMTQLLRR

SEQ ID NO: 7126 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDAAGEPPSMTQLLRR

SEQ ID NO: 7127 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDAASEPPSMTQLLRR

SEQ ID NO: 7128 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKAGVSNKDIEKETAKDAAAEPPSMTQLLRR

SEQ ID NO: 7129 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDGGGEPPSMTQLLRR

SEQ ID NO: 7130 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDGGSEPPSMTQLLRR

SEQ ID NO: 7131 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDGGAEPPSMTQLLRR

SEQ ID NO: 7132 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDGSGEPPSMTQLLRR

SEQ ID NO: 7133 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDGSSEPPSMTQLLRR

SEQ ID NO: 7134 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDGSAEPPSMTQLLRR

SEQ ID NO: 7135 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDGAGEPPSMTQLLRR

SEQ ID NO: 7136 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDGASEPPSMTQLLRR

SEQ ID NO: 7137 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDGAAEPPSMTQLLRR

SEQ ID NO: 7138 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDSGGEPPSMTQLLRR

SEQ ID NO: 7139 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDSGSEPPSMTQLLRR

SEQ ID NO: 7140 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDSGAEPPSMTQLLRR

SEQ ID NO: 7141 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDSSGEPPSMTQLLRR

SEQ ID NO: 7142 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDSSSEPPSMTQLLRR

SEQ ID NO: 7143 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDSSAEPPSMTQLLRR

SEQ ID NO: 7144 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDSAGEPPSMTQLLRR

SEQ ID NO: 7145 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDSASEPPSMTQLLRR

SEQ ID NO: 7146 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDSAAEPPSMTQLLRR

SEQ ID NO: 7147 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDAGGEPPSMTQLLRR

SEQ ID NO: 7148 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDAGSEPPSMTQLLRR

SEQ ID NO: 7149 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDAGAEPPSMTQLLRR

SEQ ID NO: 7150 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDASGEPPSMTQLLRR

SEQ ID NO: 7151 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDASSEPPSMTQLLRR

SEQ ID NO: 7152 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDASAEPPSMTQLLRR

SEQ ID NO: 7153 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDAAGEPPSMTQLLRR

SEQ ID NO: 7154 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDAASEPPSMTQLLRR

SEQ ID NO: 7155 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKGGVSNKDIEKETAKDAAAEPPSMTQLLRR

SEQ ID NO: 7156 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDGGGEPPSMTQLLRR

SEQ ID NO: 7157 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDGGSEPPSMTQLLRR

SEQ ID NO: 7158 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDGGAEPPSMTQLLRR

SEQ ID NO: 7159 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDGSGEPPSMTQLLRR

SEQ ID NO: 7160 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDGSSEPPSMTQLLRR

SEQ ID NO: 7161 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDGSAEPPSMTQLLRR

SEQ ID NO: 7162 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDGAGEPPSMTQLLRR

SEQ ID NO: 7163 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDGASEPPSMTQLLRR

SEQ ID NO: 7164 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDGAAEPPSMTQLLRR

SEQ ID NO: 7165 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDSGGEPPSMTQLLRR

SEQ ID NO: 7166 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDSGSEPPSMTQLLRR

SEQ ID NO: 7167 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDSGAEPPSMTQLLRR

SEQ ID NO: 7168 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDSSGEPPSMTQLLRR

SEQ ID NO: 7169 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDSSSEPPSMTQLLRR

SEQ ID NO: 7170 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDSSAEPPSMTQLLRR

SEQ ID NO: 7171 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDSAGEPPSMTQLLRR

SEQ ID NO: 7172 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDSASEPPSMTQLLRR

SEQ ID NO: 7173 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDSAAEPPSMTQLLRR

SEQ ID NO: 7174 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDAGGEPPSMTQLLRR

SEQ ID NO: 7175 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDAGSEPPSMTQLLRR

SEQ ID NO: 7176 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDAGAEPPSMTQLLRR

SEQ ID NO: 7177 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDASGEPPSMTQLLRR

SEQ ID NO: 7178 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDASSEPPSMTQLLRR

SEQ ID NO: 7179 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDASAEPPSMTQLLRR

SEQ ID NO: 7180 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDAAGEPPSMTQLLRR

SEQ ID NO: 7181 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDAASEPPSMTQLLRR

SEQ ID NO: 7182 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKDGVSNKDIEKETAKDAAAEPPSMTQLLRR

SEQ ID NO: 7183 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDGGGEPPSMTQLLRR

SEQ ID NO: 7184 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDGGSEPPSMTQLLRR

SEQ ID NO: 7185 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDGGAEPPSMTQLLRR

SEQ ID NO: 7186 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDGSGEPPSMTQLLRR

SEQ ID NO: 7187 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDGSSEPPSMTQLLRR

SEQ ID NO: 7188 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDGSAEPPSMTQLLRR

SEQ ID NO: 7189 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDGAGEPPSMTQLLRR

SEQ ID NO: 7190 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDGASEPPSMTQLLRR

SEQ ID NO: 7191 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDGAAEPPSMTQLLRR

SEQ ID NO: 7192 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDSGGEPPSMTQLLRR

SEQ ID NO: 7193 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDSGSEPPSMTQLLRR

SEQ ID NO: 7194 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDSGAEPPSMTQLLRR

SEQ ID NO: 7195 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDSSGEPPSMTQLLRR

SEQ ID NO: 7196 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDSSSEPPSMTQLLRR

SEQ ID NO: 7197 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDSSAEPPSMTQLLRR

SEQ ID NO: 7198 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDSAGEPPSMTQLLRR

SEQ ID NO: 7199 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDSASEPPSMTQLLRR

SEQ ID NO: 7200 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDSAAEPPSMTQLLRR

SEQ ID NO: 7201 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDAGGEPPSMTQLLRR

SEQ ID NO: 7202 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDAGSEPPSMTQLLRR

SEQ ID NO: 7203 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDAGAEPPSMTQLLRR

SEQ ID NO: 7204 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDASGEPPSMTQLLRR

SEQ ID NO: 7205 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDASSEPPSMTQLLRR

SEQ ID NO: 7206 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDASAEPPSMTQLLRR

SEQ ID NO: 7207 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDAAGEPPSMTQLLRR

SEQ ID NO: 7208 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDAASEPPSMTQLLRR

SEQ ID NO: 7209 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKHGVSNKDIEKETAKDAAAEPPSMTQLLRR

SEQ ID NO: 7210 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDGGGEPPSMTQLLRR

SEQ ID NO: 7211 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDGGSEPPSMTQLLRR

SEQ ID NO: 7212 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDGGAEPPSMTQLLRR

SEQ ID NO: 7213 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDGSGEPPSMTQLLRR

SEQ ID NO: 7214 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDGSSEPPSMTQLLRR

SEQ ID NO: 7215 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDGSAEPPSMTQLLRR

SEQ ID NO: 7216 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDGAGEPPSMTQLLRR

SEQ ID NO: 7217 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDGASEPPSMTQLLRR

SEQ ID NO: 7218 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDGAAEPPSMTQLLRR

SEQ ID NO: 7219 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDSGGEPPSMTQLLRR

SEQ ID NO: 7220 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDSGSEPPSMTQLLRR

SEQ ID NO: 7221 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDSGAEPPSMTQLLRR

SEQ ID NO: 7222 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDSSGEPPSMTQLLRR

SEQ ID NO: 7223 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDSSSEPPSMTQLLRR

SEQ ID NO: 7224 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDSSAEPPSMTQLLRR

SEQ ID NO: 7225 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDSAGEPPSMTQLLRR

SEQ ID NO: 7226 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDSASEPPSMTQLLRR

SEQ ID NO: 7227 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDSAAEPPSMTQLLRR

SEQ ID NO: 7228 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDAGGEPPSMTQLLRR

SEQ ID NO: 7229 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDAGSEPPSMTQLLRR

SEQ ID NO: 7230 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDAGAEPPSMTQLLRR

SEQ ID NO: 7231 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDASGEPPSMTQLLRR

SEQ ID NO: 7232 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDASSEPPSMTQLLRR

SEQ ID NO: 7233 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDASAEPPSMTQLLRR

SEQ ID NO: 7234 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDAAGEPPSMTQLLRR

SEQ ID NO: 7235 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDAASEPPSMTQLLRR

SEQ ID NO: 7236 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKYGVSNKDIEKETAKDAAAEPPSMTQLLRR

SEQ ID NO: 7237 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDGGGEPPSMTQLLRR

SEQ ID NO: 7238 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDGGSEPPSMTQLLRR

SEQ ID NO: 7239 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDGGAEPPSMTQLLRR

SEQ ID NO: 7240 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDGSGEPPSMTQLLRR

SEQ ID NO: 7241 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDGSSEPPSMTQLLRR

SEQ ID NO: 7242 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDGSAEPPSMTQLLRR

SEQ ID NO: 7243 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDGAGEPPSMTQLLRR

SEQ ID NO: 7244 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDGASEPPSMTQLLRR

SEQ ID NO: 7245 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDGAAEPPSMTQLLRR

SEQ ID NO: 7246 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDSGGEPPSMTQLLRR

SEQ ID NO: 7247 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDSGSEPPSMTQLLRR

SEQ ID NO: 7248 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDSGAEPPSMTQLLRR

SEQ ID NO: 7249 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDSSGEPPSMTQLLRR

SEQ ID NO: 7250 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDSSSEPPSMTQLLRR

SEQ ID NO: 7251 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDSSAEPPSMTQLLRR

SEQ ID NO: 7252 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDSAGEPPSMTQLLRR

SEQ ID NO: 7253 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDSASEPPSMTQLLRR

SEQ ID NO: 7254 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDSAAEPPSMTQLLRR

SEQ ID NO: 7255 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDAGGEPPSMTQLLRR

SEQ ID NO: 7256 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDAGSEPPSMTQLLRR

SEQ ID NO: 7257 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDAGAEPPSMTQLLRR

SEQ ID NO: 7258 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDASGEPPSMTQLLRR

SEQ ID NO: 7259 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDASSEPPSMTQLLRR

SEQ ID NO: 7260 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDASAEPPSMTQLLRR

SEQ ID NO: 7261 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDAAGEPPSMTQLLRR

SEQ ID NO: 7262 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDAASEPPSMTQLLRR

SEQ ID NO: 7263 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKKGVSNKDIEKETAKDAAAEPPSMTQLLRR

SEQ ID NO: 7264 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDGGGEPPSMTQLLRR

SEQ ID NO: 7265 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDGGSEPPSMTQLLRR

SEQ ID NO: 7266 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDGGAEPPSMTQLLRR

SEQ ID NO: 7267 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDGSGEPPSMTQLLRR

SEQ ID NO: 7268 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDGSSEPPSMTQLLRR

SEQ ID NO: 7269 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDGSAEPPSMTQLLRR

SEQ ID NO: 7270 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDGAGEPPSMTQLLRR

SEQ ID NO: 7271 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDGASEPPSMTQLLRR

SEQ ID NO: 7272 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDGAAEPPSMTQLLRR

SEQ ID NO: 7273 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDSGGEPPSMTQLLRR

SEQ ID NO: 7274 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDSGSEPPSMTQLLRR

SEQ ID NO: 7275 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDSGAEPPSMTQLLRR

SEQ ID NO: 7276 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDSSGEPPSMTQLLRR

SEQ ID NO: 7277 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDSSSEPPSMTQLLRR

SEQ ID NO: 7278 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDSSAEPPSMTQLLRR

SEQ ID NO: 7279 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDSAGEPPSMTQLLRR

SEQ ID NO: 7280 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDSASEPPSMTQLLRR

SEQ ID NO: 7281 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDSAAEPPSMTQLLRR

SEQ ID NO: 7282 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDAGGEPPSMTQLLRR

SEQ ID NO: 7283 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDAGSEPPSMTQLLRR

SEQ ID NO: 7284 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDAGAEPPSMTQLLRR

SEQ ID NO: 7285 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDASGEPPSMTQLLRR

SEQ ID NO: 7286 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDASSEPPSMTQLLRR

SEQ ID NO: 7287 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDASAEPPSMTQLLRR

SEQ ID NO: 7288 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDAAGEPPSMTQLLRR

SEQ ID NO: 7289 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDAASEPPSMTQLLRR

SEQ ID NO: 7290 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKNGVSNKDIEKETAKDAAAEPPSMTQLLRR

SEQ ID NO: 7291 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDGGGEPPSMTQLLRR

SEQ ID NO: 7292 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDGGSEPPSMTQLLRR

SEQ ID NO: 7293 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDGGAEPPSMTQLLRR

SEQ ID NO: 7294 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDGSGEPPSMTQLLRR

SEQ ID NO: 7295 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDGSSEPPSMTQLLRR

SEQ ID NO: 7296 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDGSAEPPSMTQLLRR

SEQ ID NO: 7297 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDGAGEPPSMTQLLRR

SEQ ID NO: 7298 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDGASEPPSMTQLLRR

SEQ ID NO: 7299 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDGAAEPPSMTQLLRR

SEQ ID NO: 7300 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDSGGEPPSMTQLLRR

SEQ ID NO: 7301 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDSGSEPPSMTQLLRR

SEQ ID NO: 7302 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDSGAEPPSMTQLLRR

SEQ ID NO: 7303 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDSSGEPPSMTQLLRR

SEQ ID NO: 7304 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDSSSEPPSMTQLLRR

SEQ ID NO: 7305 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDSSAEPPSMTQLLRR

SEQ ID NO: 7306 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDSAGEPPSMTQLLRR

SEQ ID NO: 7307 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDSASEPPSMTQLLRR

SEQ ID NO: 7308 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDSAAEPPSMTQLLRR

SEQ ID NO: 7309 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDAGGEPPSMTQLLRR

SEQ ID NO: 7310 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDAGSEPPSMTQLLRR

SEQ ID NO: 7311 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDAGAEPPSMTQLLRR

SEQ ID NO: 7312 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDASGEPPSMTQLLRR

SEQ ID NO: 7313 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDASSEPPSMTQLLRR

SEQ ID NO: 7314 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDASAEPPSMTQLLRR

SEQ ID NO: 7315 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDAAGEPPSMTQLLRR

SEQ ID NO: 7316 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDAASEPPSMTQLLRR

SEQ ID NO: 7317 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDYFGLRGLLHLENASYGIEPLQNSSHFEHIIYRMDDVYKEPLKMGVSNKDIEKETAKDAAAEPPSMTQLLRR

SEQ ID NO: 7318 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDGGGEPPSMTQLLRR

SEQ ID NO: 7319 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDGGSEPPSMTQLLRR

SEQ ID NO: 7320 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDGGAEPPSMTQLLRR

SEQ ID NO: 7321 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDGSGEPPSMTQLLRR

SEQ ID NO: 7322 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDGSSEPPSMTQLLRR

SEQ ID NO: 7323 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDGSAEPPSMTQLLRR

SEQ ID NO: 7324 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDGAGEPPSMTQLLRR

SEQ ID NO: 7325 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDGASEPPSMTQLLRR

SEQ ID NO: 7326 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDGAAEPPSMTQLLRR

SEQ ID NO: 7327 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDSGGEPPSMTQLLRR

SEQ ID NO: 7328 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDSGSEPPSMTQLLRR

SEQ ID NO: 7329 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDSGAEPPSMTQLLRR

SEQ ID NO: 7330 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDSSGEPPSMTQLLRR

SEQ ID NO: 7331 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDSSSEPPSMTQLLRR

SEQ ID NO: 7332 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDSSAEPPSMTQLLRR

SEQ ID NO: 7333 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDSAGEPPSMTQLLRR

SEQ ID NO: 7334 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDSASEPPSMTQLLRR

SEQ ID NO: 7335 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDSAAEPPSMTQLLRR

SEQ ID NO: 7336 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDAGGEPPSMTQLLRR

SEQ ID NO: 7337 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDAGSEPPSMTQLLRR

SEQ ID NO: 7338 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDAGAEPPSMTQLLRR

SEQ ID NO: 7339 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDASGEPPSMTQLLRR

SEQ ID NO: 7340 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDASSEPPSMTQLLRR

SEQ ID NO: 7341 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDASAEPPSMTQLLRR

SEQ ID NO: 7342 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDAAGEPPSMTQLLRR

SEQ ID NO: 7343 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDAASEPPSMTQLLRR

SEQ ID NO: 7344 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKCGVSNKDIEKETAKDAAAEPPSMTQLLRR

SEQ ID NO: 7345 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDGGGEPPSMTQLLRR

SEQ ID NO: 7346 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDGGSEPPSMTQLLRR

SEQ ID NO: 7347 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDGGAEPPSMTQLLRR

SEQ ID NO: 7348 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDGSGEPPSMTQLLRR

SEQ ID NO: 7349 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDGSSEPPSMTQLLRR

SEQ ID NO: 7350 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDGSAEPPSMTQLLRR

SEQ ID NO: 7351 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDGAGEPPSMTQLLRR

SEQ ID NO: 7352 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDGASEPPSMTQLLRR

SEQ ID NO: 7353 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDGAAEPPSMTQLLRR

SEQ ID NO: 7354 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDSGGEPPSMTQLLRR

SEQ ID NO: 7355 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDSGSEPPSMTQLLRR

SEQ ID NO: 7356 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDSGAEPPSMTQLLRR

SEQ ID NO: 7357 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDSSGEPPSMTQLLRR

SEQ ID NO: 7358 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDSSSEPPSMTQLLRR

SEQ ID NO: 7359 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDSSAEPPSMTQLLRR

SEQ ID NO: 7360 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDSAGEPPSMTQLLRR

SEQ ID NO: 7361 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDSASEPPSMTQLLRR

SEQ ID NO: 7362 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDSAAEPPSMTQLLRR

SEQ ID NO: 7363 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDAGGEPPSMTQLLRR

SEQ ID NO: 7364 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDAGSEPPSMTQLLRR

SEQ ID NO: 7365 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDAGAEPPSMTQLLRR

SEQ ID NO: 7366 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDASGEPPSMTQLLRR

SEQ ID NO: 7367 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDASSEPPSMTQLLRR

SEQ ID NO: 7368 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDASAEPPSMTQLLRR

SEQ ID NO: 7369 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDAAGEPPSMTQLLRR

SEQ ID NO: 7370 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDAASEPPSMTQLLRR

SEQ ID NO: 7371 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKSGVSNKDIEKETAKDAAAEPPSMTQLLRR

SEQ ID NO: 7372 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDGGGEPPSMTQLLRR

SEQ ID NO: 7373 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDGGSEPPSMTQLLRR

SEQ ID NO: 7374 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDGGAEPPSMTQLLRR

SEQ ID NO: 7375 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDGSGEPPSMTQLLRR

SEQ ID NO: 7376 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDGSSEPPSMTQLLRR

SEQ ID NO: 7377 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDGSAEPPSMTQLLRR

SEQ ID NO: 7378 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDGAGEPPSMTQLLRR

SEQ ID NO: 7379 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDGASEPPSMTQLLRR

SEQ ID NO: 7380 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDGAAEPPSMTQLLRR

SEQ ID NO: 7381 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDSGGEPPSMTQLLRR

SEQ ID NO: 7382 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDSGSEPPSMTQLLRR

SEQ ID NO: 7383 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDSGAEPPSMTQLLRR

SEQ ID NO: 7384 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDSSGEPPSMTQLLRR

SEQ ID NO: 7385 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDSSSEPPSMTQLLRR

SEQ ID NO: 7386 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDSSAEPPSMTQLLRR

SEQ ID NO: 7387 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDSAGEPPSMTQLLRR

SEQ ID NO: 7388 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDSASEPPSMTQLLRR

SEQ ID NO: 7389 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDSAAEPPSMTQLLRR

SEQ ID NO: 7390 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDAGGEPPSMTQLLRR

SEQ ID NO: 7391 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDAGSEPPSMTQLLRR

SEQ ID NO: 7392 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDAGAEPPSMTQLLRR

SEQ ID NO: 7393 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDASGEPPSMTQLLRR

SEQ ID NO: 7394 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDASSEPPSMTQLLRR

SEQ ID NO: 7395 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDASAEPPSMTQLLRR

SEQ ID NO: 7396 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDAAGEPPSMTQLLRR

SEQ ID NO: 7397 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDAASEPPSMTQLLRR

SEQ ID NO: 7398 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKAGVSNKDIEKETAKDAAAEPPSMTQLLRR

SEQ ID NO: 7399 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDGGGEPPSMTQLLRR

SEQ ID NO: 7400 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDGGSEPPSMTQLLRR

SEQ ID NO: 7401 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDGGAEPPSMTQLLRR

SEQ ID NO: 7402 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDGSGEPPSMTQLLRR

SEQ ID NO: 7403 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDGSSEPPSMTQLLRR

SEQ ID NO: 7404 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDGSAEPPSMTQLLRR

SEQ ID NO: 7405 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDGAGEPPSMTQLLRR

SEQ ID NO: 7406 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDGASEPPSMTQLLRR

SEQ ID NO: 7407 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDGAAEPPSMTQLLRR

SEQ ID NO: 7408 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDSGGEPPSMTQLLRR

SEQ ID NO: 7409 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDSGSEPPSMTQLLRR

SEQ ID NO: 7410 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDSGAEPPSMTQLLRR

SEQ ID NO: 7411 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDSSGEPPSMTQLLRR

SEQ ID NO: 7412 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDSSSEPPSMTQLLRR

SEQ ID NO: 7413 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDSSAEPPSMTQLLRR

SEQ ID NO: 7414 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDSAGEPPSMTQLLRR

SEQ ID NO: 7415 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDSASEPPSMTQLLRR

SEQ ID NO: 7416 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDSAAEPPSMTQLLRR

SEQ ID NO: 7417 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDAGGEPPSMTQLLRR

SEQ ID NO: 7418 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDAGSEPPSMTQLLRR

SEQ ID NO: 7419 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDAGAEPPSMTQLLRR

SEQ ID NO: 7420 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDASGEPPSMTQLLRR

SEQ ID NO: 7421 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDASSEPPSMTQLLRR

SEQ ID NO: 7422 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDASAEPPSMTQLLRR

SEQ ID NO: 7423 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDAAGEPPSMTQLLRR

SEQ ID NO: 7424 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDAASEPPSMTQLLRR

SEQ ID NO: 7425 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKGGVSNKDIEKETAKDAAAEPPSMTQLLRR

SEQ ID NO: 7426 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDGGGEPPSMTQLLRR

SEQ ID NO: 7427 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDGGSEPPSMTQLLRR

SEQ ID NO: 7428 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDGGAEPPSMTQLLRR

SEQ ID NO: 7429 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDGSGEPPSMTQLLRR

SEQ ID NO: 7430 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDGSSEPPSMTQLLRR

SEQ ID NO: 7431 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDGSAEPPSMTQLLRR

SEQ ID NO: 7432 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDGAGEPPSMTQLLRR

SEQ ID NO: 7433 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDGASEPPSMTQLLRR

SEQ ID NO: 7434 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDGAAEPPSMTQLLRR

SEQ ID NO: 7435 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDSGGEPPSMTQLLRR

SEQ ID NO: 7436 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDSGSEPPSMTQLLRR

SEQ ID NO: 7437 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDSGAEPPSMTQLLRR

SEQ ID NO: 7438 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDSSGEPPSMTQLLRR

SEQ ID NO: 7439 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDSSSEPPSMTQLLRR

SEQ ID NO: 7440 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDSSAEPPSMTQLLRR

SEQ ID NO: 7441 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDSAGEPPSMTQLLRR

SEQ ID NO: 7442 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDSASEPPSMTQLLRR

SEQ ID NO: 7443 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDSAAEPPSMTQLLRR

SEQ ID NO: 7444 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDAGGEPPSMTQLLRR

SEQ ID NO: 7445 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDAGSEPPSMTQLLRR

SEQ ID NO: 7446 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDAGAEPPSMTQLLRR

SEQ ID NO: 7447 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDASGEPPSMTQLLRR

SEQ ID NO: 7448 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDASSEPPSMTQLLRR

SEQ ID NO: 7449 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDASAEPPSMTQLLRR

SEQ ID NO: 7450 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDAAGEPPSMTQLLRR

SEQ ID NO: 7451 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDAASEPPSMTQLLRR

SEQ ID NO: 7452 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKDGVSNKDIEKETAKDAAAEPPSMTQLLRR

SEQ ID NO: 7453 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDGGGEPPSMTQLLRR

SEQ ID NO: 7454 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDGGSEPPSMTQLLRR

SEQ ID NO: 7455 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDGGAEPPSMTQLLRR

SEQ ID NO: 7456 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDGSGEPPSMTQLLRR

SEQ ID NO: 7457 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDGSSEPPSMTQLLRR

SEQ ID NO: 7458 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDGSAEPPSMTQLLRR

SEQ ID NO: 7459 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDGAGEPPSMTQLLRR

SEQ ID NO: 7460 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDGASEPPSMTQLLRR

SEQ ID NO: 7461 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDGAAEPPSMTQLLRR

SEQ ID NO: 7462 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDSGGEPPSMTQLLRR

SEQ ID NO: 7463 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDSGSEPPSMTQLLRR

SEQ ID NO: 7464 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDSGAEPPSMTQLLRR

SEQ ID NO: 7465 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDSSGEPPSMTQLLRR

SEQ ID NO: 7466 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDSSSEPPSMTQLLRR

SEQ ID NO: 7467 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDSSAEPPSMTQLLRR

SEQ ID NO: 7468 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDSAGEPPSMTQLLRR

SEQ ID NO: 7469 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDSASEPPSMTQLLRR

SEQ ID NO: 7470 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDSAAEPPSMTQLLRR

SEQ ID NO: 7471 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDAGGEPPSMTQLLRR

SEQ ID NO: 7472 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDAGSEPPSMTQLLRR

SEQ ID NO: 7473 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDAGAEPPSMTQLLRR

SEQ ID NO: 7474 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDASGEPPSMTQLLRR

SEQ ID NO: 7475 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDASSEPPSMTQLLRR

SEQ ID NO: 7476 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDASAEPPSMTQLLRR

SEQ ID NO: 7477 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDAAGEPPSMTQLLRR

SEQ ID NO: 7478 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDAASEPPSMTQLLRR

SEQ ID NO: 7479 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKHGVSNKDIEKETAKDAAAEPPSMTQLLRR

SEQ ID NO: 7480 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDGGGEPPSMTQLLRR

SEQ ID NO: 7481 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDGGSEPPSMTQLLRR

SEQ ID NO: 7482 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDGGAEPPSMTQLLRR

SEQ ID NO: 7483 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDGSGEPPSMTQLLRR

SEQ ID NO: 7484 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDGSSEPPSMTQLLRR

SEQ ID NO: 7485 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDGSAEPPSMTQLLRR

SEQ ID NO: 7486 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDGAGEPPSMTQLLRR

SEQ ID NO: 7487 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDGASEPPSMTQLLRR

SEQ ID NO: 7488 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDGAAEPPSMTQLLRR

SEQ ID NO: 7489 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDSGGEPPSMTQLLRR

SEQ ID NO: 7490 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDSGSEPPSMTQLLRR

SEQ ID NO: 7491 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDSGAEPPSMTQLLRR

SEQ ID NO: 7492 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDSSGEPPSMTQLLRR

SEQ ID NO: 7493 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDSSSEPPSMTQLLRR

SEQ ID NO: 7494 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDSSAEPPSMTQLLRR

SEQ ID NO: 7495 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDSAGEPPSMTQLLRR

SEQ ID NO: 7496 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDSASEPPSMTQLLRR

SEQ ID NO: 7497 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDSAAEPPSMTQLLRR

SEQ ID NO: 7498 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDAGGEPPSMTQLLRR

SEQ ID NO: 7499 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDAGSEPPSMTQLLRR

SEQ ID NO: 7500 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDAGAEPPSMTQLLRR

SEQ ID NO: 7501 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDASGEPPSMTQLLRR

SEQ ID NO: 7502 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDASSEPPSMTQLLRR

SEQ ID NO: 7503 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDASAEPPSMTQLLRR

SEQ ID NO: 7504 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDAAGEPPSMTQLLRR

SEQ ID NO: 7505 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDAASEPPSMTQLLRR

SEQ ID NO: 7506 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKYGVSNKDIEKETAKDAAAEPPSMTQLLRR

SEQ ID NO: 7507 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDGGGEPPSMTQLLRR

SEQ ID NO: 7508 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDGGSEPPSMTQLLRR

SEQ ID NO: 7509 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDGGAEPPSMTQLLRR

SEQ ID NO: 7510 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDGSGEPPSMTQLLRR

SEQ ID NO: 7511 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDGSSEPPSMTQLLRR

SEQ ID NO: 7512 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDGSAEPPSMTQLLRR

SEQ ID NO: 7513 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDGAGEPPSMTQLLRR

SEQ ID NO: 7514 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDGASEPPSMTQLLRR

SEQ ID NO: 7515 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDGAAEPPSMTQLLRR

SEQ ID NO: 7516 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDSGGEPPSMTQLLRR

SEQ ID NO: 7517 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDSGSEPPSMTQLLRR

SEQ ID NO: 7518 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDSGAEPPSMTQLLRR

SEQ ID NO: 7519 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDSSGEPPSMTQLLRR

SEQ ID NO: 7520 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDSSSEPPSMTQLLRR

SEQ ID NO: 7521 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDSSAEPPSMTQLLRR

SEQ ID NO: 7522 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDSAGEPPSMTQLLRR

SEQ ID NO: 7523 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDSASEPPSMTQLLRR

SEQ ID NO: 7524 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDSAAEPPSMTQLLRR

SEQ ID NO: 7525 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDAGGEPPSMTQLLRR

SEQ ID NO: 7526 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDAGSEPPSMTQLLRR

SEQ ID NO: 7527 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDAGAEPPSMTQLLRR

SEQ ID NO: 7528 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDASGEPPSMTQLLRR

SEQ ID NO: 7529 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDASSEPPSMTQLLRR

SEQ ID NO: 7530 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDASAEPPSMTQLLRR

SEQ ID NO: 7531 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDAAGEPPSMTQLLRR

SEQ ID NO: 7532 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDAASEPPSMTQLLRR

SEQ ID NO: 7533 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKKGVSNKDIEKETAKDAAAEPPSMTQLLRR

SEQ ID NO: 7534 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDGGGEPPSMTQLLRR

SEQ ID NO: 7535 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDGGSEPPSMTQLLRR

SEQ ID NO: 7536 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDGGAEPPSMTQLLRR

SEQ ID NO: 7537 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDGSGEPPSMTQLLRR

SEQ ID NO: 7538 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDGSSEPPSMTQLLRR

SEQ ID NO: 7539 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDGSAEPPSMTQLLRR

SEQ ID NO: 7540 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDGAGEPPSMTQLLRR

SEQ ID NO: 7541 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDGASEPPSMTQLLRR

SEQ ID NO: 7542 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDGAAEPPSMTQLLRR

SEQ ID NO: 7543 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDSGGEPPSMTQLLRR

SEQ ID NO: 7544 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDSGSEPPSMTQLLRR

SEQ ID NO: 7545 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDSGAEPPSMTQLLRR

SEQ ID NO: 7546 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDSSGEPPSMTQLLRR

SEQ ID NO: 7547 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDSSSEPPSMTQLLRR

SEQ ID NO: 7548 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDSSAEPPSMTQLLRR

SEQ ID NO: 7549 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDSAGEPPSMTQLLRR

SEQ ID NO: 7550 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDSASEPPSMTQLLRR

SEQ ID NO: 7551 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDSAAEPPSMTQLLRR

SEQ ID NO: 7552 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDAGGEPPSMTQLLRR

SEQ ID NO: 7553 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDAGSEPPSMTQLLRR

SEQ ID NO: 7554 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDAGAEPPSMTQLLRR

SEQ ID NO: 7555 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDASGEPPSMTQLLRR

SEQ ID NO: 7556 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDASSEPPSMTQLLRR

SEQ ID NO: 7557 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDASAEPPSMTQLLRR

SEQ ID NO: 7558 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDAAGEPPSMTQLLRR

SEQ ID NO: 7559 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDAASEPPSMTQLLRR

SEQ ID NO: 7560 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKNGVSNKDIEKETAKDAAAEPPSMTQLLRR

SEQ ID NO: 7561 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDGGGEPPSMTQLLRR

SEQ ID NO: 7562 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDGGSEPPSMTQLLRR

SEQ ID NO: 7563 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDGGAEPPSMTQLLRR

SEQ ID NO: 7564 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDGSGEPPSMTQLLRR

SEQ ID NO: 7565 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDGSSEPPSMTQLLRR

SEQ ID NO: 7566 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDGSAEPPSMTQLLRR

SEQ ID NO: 7567 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDGAGEPPSMTQLLRR

SEQ ID NO: 7568 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDGASEPPSMTQLLRR

SEQ ID NO: 7569 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDGAAEPPSMTQLLRR

SEQ ID NO: 7570 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDSGGEPPSMTQLLRR

SEQ ID NO: 7571 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDSGSEPPSMTQLLRR

SEQ ID NO: 7572 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDSGAEPPSMTQLLRR

SEQ ID NO: 7573 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDSSGEPPSMTQLLRR

SEQ ID NO: 7574 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDSSSEPPSMTQLLRR

SEQ ID NO: 7575 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDSSAEPPSMTQLLRR

SEQ ID NO: 7576 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDSAGEPPSMTQLLRR

SEQ ID NO: 7577 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDSASEPPSMTQLLRR

SEQ ID NO: 7578 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDSAAEPPSMTQLLRR

SEQ ID NO: 7579 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDAGGEPPSMTQLLRR

SEQ ID NO: 7580 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDAGSEPPSMTQLLRR

SEQ ID NO: 7581 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDAGAEPPSMTQLLRR

SEQ ID NO: 7582 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDASGEPPSMTQLLRR

SEQ ID NO: 7583 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDASSEPPSMTQLLRR

SEQ ID NO: 7584 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDASAEPPSMTQLLRR

SEQ ID NO: 7585 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDAAGEPPSMTQLLRR

SEQ ID NO: 7586 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDAASEPPSMTQLLRR

SEQ ID NO: 7587 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDKFGLRGLLHLENASYGIEPLQNSSHFEHIIYRMDDVYKEPLKMGVSNKDIEKETAKDAAAEPPSMTQLLRR

SEQ ID NO: 7588 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDGGGEPPSMTQLLRR

SEQ ID NO: 7589 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDGGSEPPSMTQLLRR

SEQ ID NO: 7590 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDGGAEPPSMTQLLRR

SEQ ID NO: 7591 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDGSGEPPSMTQLLRR

SEQ ID NO: 7592 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDGSSEPPSMTQLLRR

SEQ ID NO: 7593 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDGSAEPPSMTQLLRR

SEQ ID NO: 7594 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDGAGEPPSMTQLLRR

SEQ ID NO: 7595 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDGASEPPSMTQLLRR

SEQ ID NO: 7596 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDGAAEPPSMTQLLRR

SEQ ID NO: 7597 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDSGGEPPSMTQLLRR

SEQ ID NO: 7598 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDSGSEPPSMTQLLRR

SEQ ID NO: 7599 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDSGAEPPSMTQLLRR

SEQ ID NO: 7600 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDSSGEPPSMTQLLRR

SEQ ID NO: 7601 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDSSSEPPSMTQLLRR

SEQ ID NO: 7602 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDSSAEPPSMTQLLRR

SEQ ID NO: 7603 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDSAGEPPSMTQLLRR

SEQ ID NO: 7604 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDSASEPPSMTQLLRR

SEQ ID NO: 7605 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDSAAEPPSMTQLLRR

SEQ ID NO: 7606 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDAGGEPPSMTQLLRR

SEQ ID NO: 7607 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDAGSEPPSMTQLLRR

SEQ ID NO: 7608 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDAGAEPPSMTQLLRR

SEQ ID NO: 7609 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDASGEPPSMTQLLRR

SEQ ID NO: 7610 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDASSEPPSMTQLLRR

SEQ ID NO: 7611 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDASAEPPSMTQLLRR

SEQ ID NO: 7612 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDAAGEPPSMTQLLRR

SEQ ID NO: 7613 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDAASEPPSMTQLLRR

SEQ ID NO: 7614 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKCGVSNKDIEKETAKDAAAEPPSMTQLLRR

SEQ ID NO: 7615 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDGGGEPPSMTQLLRR

SEQ ID NO: 7616 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDGGSEPPSMTQLLRR

SEQ ID NO: 7617 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDGGAEPPSMTQLLRR

SEQ ID NO: 7618 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDGSGEPPSMTQLLRR

SEQ ID NO: 7619 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDGSSEPPSMTQLLRR

SEQ ID NO: 7620 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDGSAEPPSMTQLLRR

SEQ ID NO: 7621 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDGAGEPPSMTQLLRR

SEQ ID NO: 7622 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDGASEPPSMTQLLRR

SEQ ID NO: 7623 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDGAAEPPSMTQLLRR

SEQ ID NO: 7624 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDSGGEPPSMTQLLRR

SEQ ID NO: 7625 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDSGSEPPSMTQLLRR

SEQ ID NO: 7626 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDSGAEPPSMTQLLRR

SEQ ID NO: 7627 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDSSGEPPSMTQLLRR

SEQ ID NO: 7628 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDSSSEPPSMTQLLRR

SEQ ID NO: 7629 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDSSAEPPSMTQLLRR

SEQ ID NO: 7630 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDSAGEPPSMTQLLRR

SEQ ID NO: 7631 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDSASEPPSMTQLLRR

SEQ ID NO: 7632 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDSAAEPPSMTQLLRR

SEQ ID NO: 7633 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDAGGEPPSMTQLLRR

SEQ ID NO: 7634 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDAGSEPPSMTQLLRR

SEQ ID NO: 7635 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDAGAEPPSMTQLLRR

SEQ ID NO: 7636 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDASGEPPSMTQLLRR

SEQ ID NO: 7637 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDASSEPPSMTQLLRR

SEQ ID NO: 7638 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDASAEPPSMTQLLRR

SEQ ID NO: 7639 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDAAGEPPSMTQLLRR

SEQ ID NO: 7640 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDAASEPPSMTQLLRR

SEQ ID NO: 7641 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKSGVSNKDIEKETAKDAAAEPPSMTQLLRR

SEQ ID NO: 7642 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDGGGEPPSMTQLLRR

SEQ ID NO: 7643 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDGGSEPPSMTQLLRR

SEQ ID NO: 7644 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDGGAEPPSMTQLLRR

SEQ ID NO: 7645 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDGSGEPPSMTQLLRR

SEQ ID NO: 7646 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDGSSEPPSMTQLLRR

SEQ ID NO: 7647 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDGSAEPPSMTQLLRR

SEQ ID NO: 7648 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDGAGEPPSMTQLLRR

SEQ ID NO: 7649 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDGASEPPSMTQLLRR

SEQ ID NO: 7650 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDGAAEPPSMTQLLRR

SEQ ID NO: 7651 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDSGGEPPSMTQLLRR

SEQ ID NO: 7652 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDSGSEPPSMTQLLRR

SEQ ID NO: 7653 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDSGAEPPSMTQLLRR

SEQ ID NO: 7654 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDSSGEPPSMTQLLRR

SEQ ID NO: 7655 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDSSSEPPSMTQLLRR

SEQ ID NO: 7656 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDSSAEPPSMTQLLRR

SEQ ID NO: 7657 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDSAGEPPSMTQLLRR

SEQ ID NO: 7658 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDSASEPPSMTQLLRR

SEQ ID NO: 7659 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDSAAEPPSMTQLLRR

SEQ ID NO: 7660 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDAGGEPPSMTQLLRR

SEQ ID NO: 7661 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDAGSEPPSMTQLLRR

SEQ ID NO: 7662 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDAGAEPPSMTQLLRR

SEQ ID NO: 7663 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDASGEPPSMTQLLRR

SEQ ID NO: 7664 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDASSEPPSMTQLLRR

SEQ ID NO: 7665 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDASAEPPSMTQLLRR

SEQ ID NO: 7666 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDAAGEPPSMTQLLRR

SEQ ID NO: 7667 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDAASEPPSMTQLLRR

SEQ ID NO: 7668 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKAGVSNKDIEKETAKDAAAEPPSMTQLLRR

SEQ ID NO: 7669 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDGGGEPPSMTQLLRR

SEQ ID NO: 7670 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDGGSEPPSMTQLLRR

SEQ ID NO: 7671 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDGGAEPPSMTQLLRR

SEQ ID NO: 7672 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDGSGEPPSMTQLLRR

SEQ ID NO: 7673 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDGSSEPPSMTQLLRR

SEQ ID NO: 7674 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDGSAEPPSMTQLLRR

SEQ ID NO: 7675 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDGAGEPPSMTQLLRR

SEQ ID NO: 7676 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDGASEPPSMTQLLRR

SEQ ID NO: 7677 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDGAAEPPSMTQLLRR

SEQ ID NO: 7678 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDSGGEPPSMTQLLRR

SEQ ID NO: 7679 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDSGSEPPSMTQLLRR

SEQ ID NO: 7680 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDSGAEPPSMTQLLRR

SEQ ID NO: 7681 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDSSGEPPSMTQLLRR

SEQ ID NO: 7682 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDSSSEPPSMTQLLRR

SEQ ID NO: 7683 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDSSAEPPSMTQLLRR

SEQ ID NO: 7684 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDSAGEPPSMTQLLRR

SEQ ID NO: 7685 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDSASEPPSMTQLLRR

SEQ ID NO: 7686 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDSAAEPPSMTQLLRR

SEQ ID NO: 7687 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDAGGEPPSMTQLLRR

SEQ ID NO: 7688 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDAGSEPPSMTQLLRR

SEQ ID NO: 7689 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDAGAEPPSMTQLLRR

SEQ ID NO: 7690 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDASGEPPSMTQLLRR

SEQ ID NO: 7691 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDASSEPPSMTQLLRR

SEQ ID NO: 7692 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDASAEPPSMTQLLRR

SEQ ID NO: 7693 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDAAGEPPSMTQLLRR

SEQ ID NO: 7694 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDAASEPPSMTQLLRR

SEQ ID NO: 7695 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKGGVSNKDIEKETAKDAAAEPPSMTQLLRR

SEQ ID NO: 7696 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDGGGEPPSMTQLLRR

SEQ ID NO: 7697 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDGGSEPPSMTQLLRR

SEQ ID NO: 7698 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDGGAEPPSMTQLLRR

SEQ ID NO: 7699 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDGSGEPPSMTQLLRR

SEQ ID NO: 7700 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDGSSEPPSMTQLLRR

SEQ ID NO: 7701 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDGSAEPPSMTQLLRR

SEQ ID NO: 7702 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDGAGEPPSMTQLLRR

SEQ ID NO: 7703 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDGASEPPSMTQLLRR

SEQ ID NO: 7704 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDGAAEPPSMTQLLRR

SEQ ID NO: 7705 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDSGGEPPSMTQLLRR

SEQ ID NO: 7706 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDSGSEPPSMTQLLRR

SEQ ID NO: 7707 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDSGAEPPSMTQLLRR

SEQ ID NO: 7708 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDSSGEPPSMTQLLRR

SEQ ID NO: 7709 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDSSSEPPSMTQLLRR

SEQ ID NO: 7710 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDSSAEPPSMTQLLRR

SEQ ID NO: 7711 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDSAGEPPSMTQLLRR

SEQ ID NO: 7712 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDSASEPPSMTQLLRR

SEQ ID NO: 7713 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDSAAEPPSMTQLLRR

SEQ ID NO: 7714 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDAGGEPPSMTQLLRR

SEQ ID NO: 7715 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDAGSEPPSMTQLLRR

SEQ ID NO: 7716 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDAGAEPPSMTQLLRR

SEQ ID NO: 7717 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDASGEPPSMTQLLRR

SEQ ID NO: 7718 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDASSEPPSMTQLLRR

SEQ ID NO: 7719 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDASAEPPSMTQLLRR

SEQ ID NO: 7720 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDAAGEPPSMTQLLRR

SEQ ID NO: 7721 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDAASEPPSMTQLLRR

SEQ ID NO: 7722 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKDGVSNKDIEKETAKDAAAEPPSMTQLLRR

SEQ ID NO: 7723 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDGGGEPPSMTQLLRR

SEQ ID NO: 7724 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDGGSEPPSMTQLLRR

SEQ ID NO: 7725 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDGGAEPPSMTQLLRR

SEQ ID NO: 7726 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDGSGEPPSMTQLLRR

SEQ ID NO: 7727 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDGSSEPPSMTQLLRR

SEQ ID NO: 7728 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDGSAEPPSMTQLLRR

SEQ ID NO: 7729 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDGAGEPPSMTQLLRR

SEQ ID NO: 7730 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDGASEPPSMTQLLRR

SEQ ID NO: 7731 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDGAAEPPSMTQLLRR

SEQ ID NO: 7732 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDSGGEPPSMTQLLRR

SEQ ID NO: 7733 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDSGSEPPSMTQLLRR

SEQ ID NO: 7734 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDSGAEPPSMTQLLRR

SEQ ID NO: 7735 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDSSGEPPSMTQLLRR

SEQ ID NO: 7736 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDSSSEPPSMTQLLRR

SEQ ID NO: 7737 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDSSAEPPSMTQLLRR

SEQ ID NO: 7738 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDSAGEPPSMTQLLRR

SEQ ID NO: 7739 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDSASEPPSMTQLLRR

SEQ ID NO: 7740 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDSAAEPPSMTQLLRR

SEQ ID NO: 7741 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDAGGEPPSMTQLLRR

SEQ ID NO: 7742 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDAGSEPPSMTQLLRR

SEQ ID NO: 7743 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDAGAEPPSMTQLLRR

SEQ ID NO: 7744 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDASGEPPSMTQLLRR

SEQ ID NO: 7745 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDASSEPPSMTQLLRR

SEQ ID NO: 7746 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDASAEPPSMTQLLRR

SEQ ID NO: 7747 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDAAGEPPSMTQLLRR

SEQ ID NO: 7748 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDAASEPPSMTQLLRR

SEQ ID NO: 7749 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKHGVSNKDIEKETAKDAAAEPPSMTQLLRR

SEQ ID NO: 7750 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDGGGEPPSMTQLLRR

SEQ ID NO: 7751 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDGGSEPPSMTQLLRR

SEQ ID NO: 7752 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDGGAEPPSMTQLLRR

SEQ ID NO: 7753 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDGSGEPPSMTQLLRR

SEQ ID NO: 7754 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDGSSEPPSMTQLLRR

SEQ ID NO: 7755 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDGSAEPPSMTQLLRR

SEQ ID NO: 7756 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDGAGEPPSMTQLLRR

SEQ ID NO: 7757 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDGASEPPSMTQLLRR

SEQ ID NO: 7758 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDGAAEPPSMTQLLRR

SEQ ID NO: 7759 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDSGGEPPSMTQLLRR

SEQ ID NO: 7760 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDSGSEPPSMTQLLRR

SEQ ID NO: 7761 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDSGAEPPSMTQLLRR

SEQ ID NO: 7762 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDSSGEPPSMTQLLRR

SEQ ID NO: 7763 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDSSSEPPSMTQLLRR

SEQ ID NO: 7764 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDSSAEPPSMTQLLRR

SEQ ID NO: 7765 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDSAGEPPSMTQLLRR

SEQ ID NO: 7766 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDSASEPPSMTQLLRR

SEQ ID NO: 7767 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDSAAEPPSMTQLLRR

SEQ ID NO: 7768 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDAGGEPPSMTQLLRR

SEQ ID NO: 7769 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDAGSEPPSMTQLLRR

SEQ ID NO: 7770 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDAGAEPPSMTQLLRR

SEQ ID NO: 7771 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDASGEPPSMTQLLRR

SEQ ID NO: 7772 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDASSEPPSMTQLLRR

SEQ ID NO: 7773 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDASAEPPSMTQLLRR

SEQ ID NO: 7774 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDAAGEPPSMTQLLRR

SEQ ID NO: 7775 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDAASEPPSMTQLLRR

SEQ ID NO: 7776 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKYGVSNKDIEKETAKDAAAEPPSMTQLLRR

SEQ ID NO: 7777 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDGGGEPPSMTQLLRR

SEQ ID NO: 7778 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDGGSEPPSMTQLLRR

SEQ ID NO: 7779 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDGGAEPPSMTQLLRR

SEQ ID NO: 7780 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDGSGEPPSMTQLLRR

SEQ ID NO: 7781 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDGSSEPPSMTQLLRR

SEQ ID NO: 7782 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDGSAEPPSMTQLLRR

SEQ ID NO: 7783 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDGAGEPPSMTQLLRR

SEQ ID NO: 7784 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDGASEPPSMTQLLRR

SEQ ID NO: 7785 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDGAAEPPSMTQLLRR

SEQ ID NO: 7786 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDSGGEPPSMTQLLRR

SEQ ID NO: 7787 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDSGSEPPSMTQLLRR

SEQ ID NO: 7788 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDSGAEPPSMTQLLRR

SEQ ID NO: 7789 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDSSGEPPSMTQLLRR

SEQ ID NO: 7790 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDSSSEPPSMTQLLRR

SEQ ID NO: 7791 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDSSAEPPSMTQLLRR

SEQ ID NO: 7792 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDSAGEPPSMTQLLRR

SEQ ID NO: 7793 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDSASEPPSMTQLLRR

SEQ ID NO: 7794 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDSAAEPPSMTQLLRR

SEQ ID NO: 7795 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDAGGEPPSMTQLLRR

SEQ ID NO: 7796 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDAGSEPPSMTQLLRR

SEQ ID NO: 7797 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDAGAEPPSMTQLLRR

SEQ ID NO: 7798 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDASGEPPSMTQLLRR

SEQ ID NO: 7799 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDASSEPPSMTQLLRR

SEQ ID NO: 7800 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDASAEPPSMTQLLRR

SEQ ID NO: 7801 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDAAGEPPSMTQLLRR

SEQ ID NO: 7802 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDAASEPPSMTQLLRR

SEQ ID NO: 7803 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKKGVSNKDIEKETAKDAAAEPPSMTQLLRR

SEQ ID NO: 7804 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDGGGEPPSMTQLLRR

SEQ ID NO: 7805 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDGGSEPPSMTQLLRR

SEQ ID NO: 7806 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDGGAEPPSMTQLLRR

SEQ ID NO: 7807 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDGSGEPPSMTQLLRR

SEQ ID NO: 7808 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDGSSEPPSMTQLLRR

SEQ ID NO: 7809 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDGSAEPPSMTQLLRR

SEQ ID NO: 7810 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDGAGEPPSMTQLLRR

SEQ ID NO: 7811 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDGASEPPSMTQLLRR

SEQ ID NO: 7812 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDGAAEPPSMTQLLRR

SEQ ID NO: 7813 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDSGGEPPSMTQLLRR

SEQ ID NO: 7814 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDSGSEPPSMTQLLRR

SEQ ID NO: 7815 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDSGAEPPSMTQLLRR

SEQ ID NO: 7816 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDSSGEPPSMTQLLRR

SEQ ID NO: 7817 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDSSSEPPSMTQLLRR

SEQ ID NO: 7818 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDSSAEPPSMTQLLRR

SEQ ID NO: 7819 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDSAGEPPSMTQLLRR

SEQ ID NO: 7820 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDSASEPPSMTQLLRR

SEQ ID NO: 7821 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDSAAEPPSMTQLLRR

SEQ ID NO: 7822 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDAGGEPPSMTQLLRR

SEQ ID NO: 7823 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDAGSEPPSMTQLLRR

SEQ ID NO: 7824 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDAGAEPPSMTQLLRR

SEQ ID NO: 7825 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDASGEPPSMTQLLRR

SEQ ID NO: 7826 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDASSEPPSMTQLLRR

SEQ ID NO: 7827 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDASAEPPSMTQLLRR

SEQ ID NO: 7828 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDAAGEPPSMTQLLRR

SEQ ID NO: 7829 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDAASEPPSMTQLLRR

SEQ ID NO: 7830 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKNGVSNKDIEKETAKDAAAEPPSMTQLLRR

SEQ ID NO: 7831 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDGGGEPPSMTQLLRR

SEQ ID NO: 7832 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDGGSEPPSMTQLLRR

SEQ ID NO: 7833 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDGGAEPPSMTQLLRR

SEQ ID NO: 7834 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDGSGEPPSMTQLLRR

SEQ ID NO: 7835 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDGSSEPPSMTQLLRR

SEQ ID NO: 7836 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDGSAEPPSMTQLLRR

SEQ ID NO: 7837 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDGAGEPPSMTQLLRR

SEQ ID NO: 7838 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDGASEPPSMTQLLRR

SEQ ID NO: 7839 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDGAAEPPSMTQLLRR

SEQ ID NO: 7840 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDSGGEPPSMTQLLRR

SEQ ID NO: 7841 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDSGSEPPSMTQLLRR

SEQ ID NO: 7842 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDSGAEPPSMTQLLRR

SEQ ID NO: 7843 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDSSGEPPSMTQLLRR

SEQ ID NO: 7844 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDSSSEPPSMTQLLRR

SEQ ID NO: 7845 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDSSAEPPSMTQLLRR

SEQ ID NO: 7846 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDSAGEPPSMTQLLRR

SEQ ID NO: 7847 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDSASEPPSMTQLLRR

SEQ ID NO: 7848 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDSAAEPPSMTQLLRR

SEQ ID NO: 7849 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDAGGEPPSMTQLLRR

SEQ ID NO: 7850 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDAGSEPPSMTQLLRR

SEQ ID NO: 7851 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDAGAEPPSMTQLLRR

SEQ ID NO: 7852 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDASGEPPSMTQLLRR

SEQ ID NO: 7853 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDASSEPPSMTQLLRR

SEQ ID NO: 7854 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDASAEPPSMTQLLRR

SEQ ID NO: 7855 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDAAGEPPSMTQLLRR

SEQ ID NO: 7856 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDAASEPPSMTQLLRR

SEQ ID NO: 7857 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDNFGLRGLLHLENASYGIEPLQNSSHFEHIIYRMDDVYKEPLKMGVSNKDIEKETAKDAAAEPPSMTQLLRR

SEQ ID NO: 7858 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDGGGEPPSMTQLLRR

SEQ ID NO: 7859 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDGGSEPPSMTQLLRR

SEQ ID NO: 7860 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDGGAEPPSMTQLLRR

SEQ ID NO: 7861 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDGSGEPPSMTQLLRR

SEQ ID NO: 7862 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDGSSEPPSMTQLLRR

SEQ ID NO: 7863 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDGSAEPPSMTQLLRR

SEQ ID NO: 7864 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDGAGEPPSMTQLLRR

SEQ ID NO: 7865 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDGASEPPSMTQLLRR

SEQ ID NO: 7866 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDGAAEPPSMTQLLRR

SEQ ID NO: 7867 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDSGGEPPSMTQLLRR

SEQ ID NO: 7868 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDSGSEPPSMTQLLRR

SEQ ID NO: 7869 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDSGAEPPSMTQLLRR

SEQ ID NO: 7870 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDSSGEPPSMTQLLRR

SEQ ID NO: 7871 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDSSSEPPSMTQLLRR

SEQ ID NO: 7872 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDSSAEPPSMTQLLRR

SEQ ID NO: 7873 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDSAGEPPSMTQLLRR

SEQ ID NO: 7874 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDSASEPPSMTQLLRR

SEQ ID NO: 7875 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDSAAEPPSMTQLLRR

SEQ ID NO: 7876 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDAGGEPPSMTQLLRR

SEQ ID NO: 7877 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDAGSEPPSMTQLLRR

SEQ ID NO: 7878 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDAGAEPPSMTQLLRR

SEQ ID NO: 7879 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDASGEPPSMTQLLRR

SEQ ID NO: 7880 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDASSEPPSMTQLLRR

SEQ ID NO: 7881 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDASAEPPSMTQLLRR

SEQ ID NO: 7882 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDAAGEPPSMTQLLRR

SEQ ID NO: 7883 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDAASEPPSMTQLLRR

SEQ ID NO: 7884 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKCGVSNKDIEKETAKDAAAEPPSMTQLLRR

SEQ ID NO: 7885 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDGGGEPPSMTQLLRR

SEQ ID NO: 7886 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDGGSEPPSMTQLLRR

SEQ ID NO: 7887 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDGGAEPPSMTQLLRR

SEQ ID NO: 7888 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDGSGEPPSMTQLLRR

SEQ ID NO: 7889 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDGSSEPPSMTQLLRR

SEQ ID NO: 7890 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDGSAEPPSMTQLLRR

SEQ ID NO: 7891 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDGAGEPPSMTQLLRR

SEQ ID NO: 7892 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDGASEPPSMTQLLRR

SEQ ID NO: 7893 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDGAAEPPSMTQLLRR

SEQ ID NO: 7894 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDSGGEPPSMTQLLRR

SEQ ID NO: 7895 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDSGSEPPSMTQLLRR

SEQ ID NO: 7896 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDSGAEPPSMTQLLRR

SEQ ID NO: 7897 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDSSGEPPSMTQLLRR

SEQ ID NO: 7898 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDSSSEPPSMTQLLRR

SEQ ID NO: 7899 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDSSAEPPSMTQLLRR

SEQ ID NO: 7900 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDSAGEPPSMTQLLRR

SEQ ID NO: 7901 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDSASEPPSMTQLLRR

SEQ ID NO: 7902 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDSAAEPPSMTQLLRR

SEQ ID NO: 7903 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDAGGEPPSMTQLLRR

SEQ ID NO: 7904 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDAGSEPPSMTQLLRR

SEQ ID NO: 7905 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDAGAEPPSMTQLLRR

SEQ ID NO: 7906 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDASGEPPSMTQLLRR

SEQ ID NO: 7907 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDASSEPPSMTQLLRR

SEQ ID NO: 7908 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDASAEPPSMTQLLRR

SEQ ID NO: 7909 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDAAGEPPSMTQLLRR

SEQ ID NO: 7910 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDAASEPPSMTQLLRR

SEQ ID NO: 7911 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKSGVSNKDIEKETAKDAAAEPPSMTQLLRR

SEQ ID NO: 7912 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDGGGEPPSMTQLLRR

SEQ ID NO: 7913 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDGGSEPPSMTQLLRR

SEQ ID NO: 7914 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDGGAEPPSMTQLLRR

SEQ ID NO: 7915 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDGSGEPPSMTQLLRR

SEQ ID NO: 7916 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDGSSEPPSMTQLLRR

SEQ ID NO: 7917 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDGSAEPPSMTQLLRR

SEQ ID NO: 7918 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDGAGEPPSMTQLLRR

SEQ ID NO: 7919 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDGASEPPSMTQLLRR

SEQ ID NO: 7920 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDGAAEPPSMTQLLRR

SEQ ID NO: 7921 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDSGGEPPSMTQLLRR

SEQ ID NO: 7922 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDSGSEPPSMTQLLRR

SEQ ID NO: 7923 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDSGAEPPSMTQLLRR

SEQ ID NO: 7924 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDSSGEPPSMTQLLRR

SEQ ID NO: 7925 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDSSSEPPSMTQLLRR

SEQ ID NO: 7926 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDSSAEPPSMTQLLRR

SEQ ID NO: 7927 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDSAGEPPSMTQLLRR

SEQ ID NO: 7928 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDSASEPPSMTQLLRR

SEQ ID NO: 7929 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDSAAEPPSMTQLLRR

SEQ ID NO: 7930 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDAGGEPPSMTQLLRR

SEQ ID NO: 7931 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDAGSEPPSMTQLLRR

SEQ ID NO: 7932 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDAGAEPPSMTQLLRR

SEQ ID NO: 7933 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDASGEPPSMTQLLRR

SEQ ID NO: 7934 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDASSEPPSMTQLLRR

SEQ ID NO: 7935 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDASAEPPSMTQLLRR

SEQ ID NO: 7936 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDAAGEPPSMTQLLRR

SEQ ID NO: 7937 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDAASEPPSMTQLLRR

SEQ ID NO: 7938 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKAGVSNKDIEKETAKDAAAEPPSMTQLLRR

SEQ ID NO: 7939 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDGGGEPPSMTQLLRR

SEQ ID NO: 7940 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDGGSEPPSMTQLLRR

SEQ ID NO: 7941 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDGGAEPPSMTQLLRR

SEQ ID NO: 7942 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDGSGEPPSMTQLLRR

SEQ ID NO: 7943 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDGSSEPPSMTQLLRR

SEQ ID NO: 7944 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDGSAEPPSMTQLLRR

SEQ ID NO: 7945 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDGAGEPPSMTQLLRR

SEQ ID NO: 7946 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDGASEPPSMTQLLRR

SEQ ID NO: 7947 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDGAAEPPSMTQLLRR

SEQ ID NO: 7948 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDSGGEPPSMTQLLRR

SEQ ID NO: 7949 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDSGSEPPSMTQLLRR

SEQ ID NO: 7950 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDSGAEPPSMTQLLRR

SEQ ID NO: 7951 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDSSGEPPSMTQLLRR

SEQ ID NO: 7952 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDSSSEPPSMTQLLRR

SEQ ID NO: 7953 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDSSAEPPSMTQLLRR

SEQ ID NO: 7954 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDSAGEPPSMTQLLRR

SEQ ID NO: 7955 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDSASEPPSMTQLLRR

SEQ ID NO: 7956 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDSAAEPPSMTQLLRR

SEQ ID NO: 7957 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDAGGEPPSMTQLLRR

SEQ ID NO: 7958 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDAGSEPPSMTQLLRR

SEQ ID NO: 7959 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDAGAEPPSMTQLLRR

SEQ ID NO: 7960 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDASGEPPSMTQLLRR

SEQ ID NO: 7961 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDASSEPPSMTQLLRR

SEQ ID NO: 7962 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDASAEPPSMTQLLRR

SEQ ID NO: 7963 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDAAGEPPSMTQLLRR

SEQ ID NO: 7964 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDAASEPPSMTQLLRR

SEQ ID NO: 7965 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKGGVSNKDIEKETAKDAAAEPPSMTQLLRR

SEQ ID NO: 7966 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDGGGEPPSMTQLLRR

SEQ ID NO: 7967 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDGGSEPPSMTQLLRR

SEQ ID NO: 7968 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDGGAEPPSMTQLLRR

SEQ ID NO: 7969 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDGSGEPPSMTQLLRR

SEQ ID NO: 7970 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDGSSEPPSMTQLLRR

SEQ ID NO: 7971 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDGSAEPPSMTQLLRR

SEQ ID NO: 7972 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDGAGEPPSMTQLLRR

SEQ ID NO: 7973 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDGASEPPSMTQLLRR

SEQ ID NO: 7974 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDGAAEPPSMTQLLRR

SEQ ID NO: 7975 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDSGGEPPSMTQLLRR

SEQ ID NO: 7976 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDSGSEPPSMTQLLRR

SEQ ID NO: 7977 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDSGAEPPSMTQLLRR

SEQ ID NO: 7978 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDSSGEPPSMTQLLRR

SEQ ID NO: 7979 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDSSSEPPSMTQLLRR

SEQ ID NO: 7980 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDSSAEPPSMTQLLRR

SEQ ID NO: 7981 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDSAGEPPSMTQLLRR

SEQ ID NO: 7982 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDSASEPPSMTQLLRR

SEQ ID NO: 7983 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDSAAEPPSMTQLLRR

SEQ ID NO: 7984 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDAGGEPPSMTQLLRR

SEQ ID NO: 7985 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDAGSEPPSMTQLLRR

SEQ ID NO: 7986 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDAGAEPPSMTQLLRR

SEQ ID NO: 7987 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDASGEPPSMTQLLRR

SEQ ID NO: 7988 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDASSEPPSMTQLLRR

SEQ ID NO: 7989 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDASAEPPSMTQLLRR

SEQ ID NO: 7990 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDAAGEPPSMTQLLRR

SEQ ID NO: 7991 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDAASEPPSMTQLLRR

SEQ ID NO: 7992 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKDGVSNKDIEKETAKDAAAEPPSMTQLLRR

SEQ ID NO: 7993 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDGGGEPPSMTQLLRR

SEQ ID NO: 7994 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDGGSEPPSMTQLLRR

SEQ ID NO: 7995 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDGGAEPPSMTQLLRR

SEQ ID NO: 7996 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDGSGEPPSMTQLLRR

SEQ ID NO: 7997 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDGSSEPPSMTQLLRR

SEQ ID NO: 7998 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDGSAEPPSMTQLLRR

SEQ ID NO: 7999 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDGAGEPPSMTQLLRR

SEQ ID NO: 8000 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDGASEPPSMTQLLRR

SEQ ID NO: 8001 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDGAAEPPSMTQLLRR

SEQ ID NO: 8002 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDSGGEPPSMTQLLRR

SEQ ID NO: 8003 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDSGSEPPSMTQLLRR

SEQ ID NO: 8004 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDSGAEPPSMTQLLRR

SEQ ID NO: 8005 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDSSGEPPSMTQLLRR

SEQ ID NO: 8006 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDSSSEPPSMTQLLRR

SEQ ID NO: 8007 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDSSAEPPSMTQLLRR

SEQ ID NO: 8008 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDSAGEPPSMTQLLRR

SEQ ID NO: 8009 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDSASEPPSMTQLLRR

SEQ ID NO: 8010 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDSAAEPPSMTQLLRR

SEQ ID NO: 8011 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDAGGEPPSMTQLLRR

SEQ ID NO: 8012 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDAGSEPPSMTQLLRR

SEQ ID NO: 8013 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDAGAEPPSMTQLLRR

SEQ ID NO: 8014 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDASGEPPSMTQLLRR

SEQ ID NO: 8015 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDASSEPPSMTQLLRR

SEQ ID NO: 8016 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDASAEPPSMTQLLRR

SEQ ID NO: 8017 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDAAGEPPSMTQLLRR

SEQ ID NO: 8018 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDAASEPPSMTQLLRR

SEQ ID NO: 8019 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKHGVSNKDIEKETAKDAAAEPPSMTQLLRR

SEQ ID NO: 8020 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDGGGEPPSMTQLLRR

SEQ ID NO: 8021 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDGGSEPPSMTQLLRR

SEQ ID NO: 8022 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDGGAEPPSMTQLLRR

SEQ ID NO: 8023 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDGSGEPPSMTQLLRR

SEQ ID NO: 8024 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDGSSEPPSMTQLLRR

SEQ ID NO: 8025 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDGSAEPPSMTQLLRR

SEQ ID NO: 8026 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDGAGEPPSMTQLLRR

SEQ ID NO: 8027 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDGASEPPSMTQLLRR

SEQ ID NO: 8028 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDGAAEPPSMTQLLRR

SEQ ID NO: 8029 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDSGGEPPSMTQLLRR

SEQ ID NO: 8030 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDSGSEPPSMTQLLRR

SEQ ID NO: 8031 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDSGAEPPSMTQLLRR

SEQ ID NO: 8032 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDSSGEPPSMTQLLRR

SEQ ID NO: 8033 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDSSSEPPSMTQLLRR

SEQ ID NO: 8034 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDSSAEPPSMTQLLRR

SEQ ID NO: 8035 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDSAGEPPSMTQLLRR

SEQ ID NO: 8036 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDSASEPPSMTQLLRR

SEQ ID NO: 8037 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDSAAEPPSMTQLLRR

SEQ ID NO: 8038 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDAGGEPPSMTQLLRR

SEQ ID NO: 8039 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDAGSEPPSMTQLLRR

SEQ ID NO: 8040 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDAGAEPPSMTQLLRR

SEQ ID NO: 8041 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDASGEPPSMTQLLRR

SEQ ID NO: 8042 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDASSEPPSMTQLLRR

SEQ ID NO: 8043 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDASAEPPSMTQLLRR

SEQ ID NO: 8044 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDAAGEPPSMTQLLRR

SEQ ID NO: 8045 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDAASEPPSMTQLLRR

SEQ ID NO: 8046 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKYGVSNKDIEKETAKDAAAEPPSMTQLLRR

SEQ ID NO: 8047 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDGGGEPPSMTQLLRR

SEQ ID NO: 8048 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDGGSEPPSMTQLLRR

SEQ ID NO: 8049 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDGGAEPPSMTQLLRR

SEQ ID NO: 8050 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDGSGEPPSMTQLLRR

SEQ ID NO: 8051 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDGSSEPPSMTQLLRR

SEQ ID NO: 8052 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDGSAEPPSMTQLLRR

SEQ ID NO: 8053 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDGAGEPPSMTQLLRR

SEQ ID NO: 8054 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDGASEPPSMTQLLRR

SEQ ID NO: 8055 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDGAAEPPSMTQLLRR

SEQ ID NO: 8056 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDSGGEPPSMTQLLRR

SEQ ID NO: 8057 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDSGSEPPSMTQLLRR

SEQ ID NO: 8058 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDSGAEPPSMTQLLRR

SEQ ID NO: 8059 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDSSGEPPSMTQLLRR

SEQ ID NO: 8060 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDSSSEPPSMTQLLRR

SEQ ID NO: 8061 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDSSAEPPSMTQLLRR

SEQ ID NO: 8062 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDSAGEPPSMTQLLRR

SEQ ID NO: 8063 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDSASEPPSMTQLLRR

SEQ ID NO: 8064 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDSAAEPPSMTQLLRR

SEQ ID NO: 8065 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDAGGEPPSMTQLLRR

SEQ ID NO: 8066 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDAGSEPPSMTQLLRR

SEQ ID NO: 8067 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDAGAEPPSMTQLLRR

SEQ ID NO: 8068 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDASGEPPSMTQLLRR

SEQ ID NO: 8069 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDASSEPPSMTQLLRR

SEQ ID NO: 8070 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDASAEPPSMTQLLRR

SEQ ID NO: 8071 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDAAGEPPSMTQLLRR

SEQ ID NO: 8072 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDAASEPPSMTQLLRR

SEQ ID NO: 8073 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKKGVSNKDIEKETAKDAAAEPPSMTQLLRR

SEQ ID NO: 8074 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDGGGEPPSMTQLLRR

SEQ ID NO: 8075 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDGGSEPPSMTQLLRR

SEQ ID NO: 8076 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDGGAEPPSMTQLLRR

SEQ ID NO: 8077 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDGSGEPPSMTQLLRR

SEQ ID NO: 8078 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDGSSEPPSMTQLLRR

SEQ ID NO: 8079 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDGSAEPPSMTQLLRR

SEQ ID NO: 8080 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDGAGEPPSMTQLLRR

SEQ ID NO: 8081 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDGASEPPSMTQLLRR

SEQ ID NO: 8082 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDGAAEPPSMTQLLRR

SEQ ID NO: 8083 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDSGGEPPSMTQLLRR

SEQ ID NO: 8084 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDSGSEPPSMTQLLRR

SEQ ID NO: 8085 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDSGAEPPSMTQLLRR

SEQ ID NO: 8086 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDSSGEPPSMTQLLRR

SEQ ID NO: 8087 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDSSSEPPSMTQLLRR

SEQ ID NO: 8088 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDSSAEPPSMTQLLRR

SEQ ID NO: 8089 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDSAGEPPSMTQLLRR

SEQ ID NO: 8090 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDSASEPPSMTQLLRR

SEQ ID NO: 8091 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDSAAEPPSMTQLLRR

SEQ ID NO: 8092 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDAGGEPPSMTQLLRR

SEQ ID NO: 8093 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDAGSEPPSMTQLLRR

SEQ ID NO: 8094 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDAGAEPPSMTQLLRR

SEQ ID NO: 8095 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDASGEPPSMTQLLRR

SEQ ID NO: 8096 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDASSEPPSMTQLLRR

SEQ ID NO: 8097 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDASAEPPSMTQLLRR

SEQ ID NO: 8098 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDAAGEPPSMTQLLRR

SEQ ID NO: 8099 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDAASEPPSMTQLLRR

SEQ ID NO: 8100 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKNGVSNKDIEKETAKDAAAEPPSMTQLLRR

SEQ ID NO: 8101 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDGGGEPPSMTQLLRR

SEQ ID NO: 8102 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDGGSEPPSMTQLLRR

SEQ ID NO: 8103 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDGGAEPPSMTQLLRR

SEQ ID NO: 8104 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDGSGEPPSMTQLLRR

SEQ ID NO: 8105 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDGSSEPPSMTQLLRR

SEQ ID NO: 8106 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDGSAEPPSMTQLLRR

SEQ ID NO: 8107 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDGAGEPPSMTQLLRR

SEQ ID NO: 8108 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDGASEPPSMTQLLRR

SEQ ID NO: 8109 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDGAAEPPSMTQLLRR

SEQ ID NO: 8110 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDSGGEPPSMTQLLRR

SEQ ID NO: 8111 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDSGSEPPSMTQLLRR

SEQ ID NO: 8112 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDSGAEPPSMTQLLRR

SEQ ID NO: 8113 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDSSGEPPSMTQLLRR

SEQ ID NO: 8114 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDSSSEPPSMTQLLRR

SEQ ID NO: 8115 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDSSAEPPSMTQLLRR

SEQ ID NO: 8116 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDSAGEPPSMTQLLRR

SEQ ID NO: 8117 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDSASEPPSMTQLLRR

SEQ ID NO: 8118 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDSAAEPPSMTQLLRR

SEQ ID NO: 8119 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDAGGEPPSMTQLLRR

SEQ ID NO: 8120 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDAGSEPPSMTQLLRR

SEQ ID NO: 8121 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDAGAEPPSMTQLLRR

SEQ ID NO: 8122 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDASGEPPSMTQLLRR

SEQ ID NO: 8123 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDASSEPPSMTQLLRR

SEQ ID NO: 8124 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDASAEPPSMTQLLRR

SEQ ID NO: 8125 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDAAGEPPSMTQLLRR

SEQ ID NO: 8126 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDAASEPPSMTQLLRR

SEQ ID NO: 8127 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHAHYRGYVEGVHNSSIALSDMFGLRGLLHLENASYGIEPLQNSSHFEHIIYRMDDVYKEPLKMGVSNKDIEKETAKDAAAEPPSMTQLLRR

SEQ ID NO: 8128 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDGGGEPPSMTQLLRR

SEQ ID NO: 8129 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDGGSEPPSMTQLLRR

SEQ ID NO: 8130 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDGGAEPPSMTQLLRR

SEQ ID NO: 8131 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDGSGEPPSMTQLLRR

SEQ ID NO: 8132 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDGSSEPPSMTQLLRR

SEQ ID NO: 8133 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDGSAEPPSMTQLLRR

SEQ ID NO: 8134 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDGAGEPPSMTQLLRR

SEQ ID NO: 8135 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDGASEPPSMTQLLRR

SEQ ID NO: 8136 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDGAAEPPSMTQLLRR

SEQ ID NO: 8137 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDSGGEPPSMTQLLRR

SEQ ID NO: 8138 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDSGSEPPSMTQLLRR

SEQ ID NO: 8139 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDSGAEPPSMTQLLRR

SEQ ID NO: 8140 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDSSGEPPSMTQLLRR

SEQ ID NO: 8141 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDSSSEPPSMTQLLRR

SEQ ID NO: 8142 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDSSAEPPSMTQLLRR

SEQ ID NO: 8143 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDSAGEPPSMTQLLRR

SEQ ID NO: 8144 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDSASEPPSMTQLLRR

SEQ ID NO: 8145 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDSAAEPPSMTQLLRR

SEQ ID NO: 8146 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDAGGEPPSMTQLLRR

SEQ ID NO: 8147 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDAGSEPPSMTQLLRR

SEQ ID NO: 8148 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDAGAEPPSMTQLLRR

SEQ ID NO: 8149 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDASGEPPSMTQLLRR

SEQ ID NO: 8150 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDASSEPPSMTQLLRR

SEQ ID NO: 8151 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDASAEPPSMTQLLRR

SEQ ID NO: 8152 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDAAGEPPSMTQLLRR

SEQ ID NO: 8153 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDAASEPPSMTQLLRR

SEQ ID NO: 8154 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKCGVSNKDIEKETAKDAAAEPPSMTQLLRR

SEQ ID NO: 8155 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDGGGEPPSMTQLLRR

SEQ ID NO: 8156 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDGGSEPPSMTQLLRR

SEQ ID NO: 8157 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDGGAEPPSMTQLLRR

SEQ ID NO: 8158 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDGSGEPPSMTQLLRR

SEQ ID NO: 8159 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDGSSEPPSMTQLLRR

SEQ ID NO: 8160 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDGSAEPPSMTQLLRR

SEQ ID NO: 8161 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDGAGEPPSMTQLLRR

SEQ ID NO: 8162 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDGASEPPSMTQLLRR

SEQ ID NO: 8163 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDGAAEPPSMTQLLRR

SEQ ID NO: 8164 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDSGGEPPSMTQLLRR

SEQ ID NO: 8165 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDSGSEPPSMTQLLRR

SEQ ID NO: 8166 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDSGAEPPSMTQLLRR

SEQ ID NO: 8167 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDSSGEPPSMTQLLRR

SEQ ID NO: 8168 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDSSSEPPSMTQLLRR

SEQ ID NO: 8169 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDSSAEPPSMTQLLRR

SEQ ID NO: 8170 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDSAGEPPSMTQLLRR

SEQ ID NO: 8171 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDSASEPPSMTQLLRR

SEQ ID NO: 8172 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDSAAEPPSMTQLLRR

SEQ ID NO: 8173 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDAGGEPPSMTQLLRR

SEQ ID NO: 8174 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDAGSEPPSMTQLLRR

SEQ ID NO: 8175 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDAGAEPPSMTQLLRR

SEQ ID NO: 8176 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDASGEPPSMTQLLRR

SEQ ID NO: 8177 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDASSEPPSMTQLLRR

SEQ ID NO: 8178 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDASAEPPSMTQLLRR

SEQ ID NO: 8179 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDAAGEPPSMTQLLRR

SEQ ID NO: 8180 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDAASEPPSMTQLLRR

SEQ ID NO: 8181 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKSGVSNKDIEKETAKDAAAEPPSMTQLLRR

SEQ ID NO: 8182 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDGGGEPPSMTQLLRR

SEQ ID NO: 8183 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDGGSEPPSMTQLLRR

SEQ ID NO: 8184 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDGGAEPPSMTQLLRR

SEQ ID NO: 8185 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDGSGEPPSMTQLLRR

SEQ ID NO: 8186 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDGSSEPPSMTQLLRR

SEQ ID NO: 8187 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDGSAEPPSMTQLLRR

SEQ ID NO: 8188 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDGAGEPPSMTQLLRR

SEQ ID NO: 8189 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDGASEPPSMTQLLRR

SEQ ID NO: 8190 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDGAAEPPSMTQLLRR

SEQ ID NO: 8191 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDSGGEPPSMTQLLRR

SEQ ID NO: 8192 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDSGSEPPSMTQLLRR

SEQ ID NO: 8193 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDSGAEPPSMTQLLRR

SEQ ID NO: 8194 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDSSGEPPSMTQLLRR

SEQ ID NO: 8195 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDSSSEPPSMTQLLRR

SEQ ID NO: 8196 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDSSAEPPSMTQLLRR

SEQ ID NO: 8197 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDSAGEPPSMTQLLRR

SEQ ID NO: 8198 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDSASEPPSMTQLLRR

SEQ ID NO: 8199 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDSAAEPPSMTQLLRR

SEQ ID NO: 8200 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDAGGEPPSMTQLLRR

SEQ ID NO: 8201 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDAGSEPPSMTQLLRR

SEQ ID NO: 8202 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDAGAEPPSMTQLLRR

SEQ ID NO: 8203 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDASGEPPSMTQLLRR

SEQ ID NO: 8204 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDASSEPPSMTQLLRR

SEQ ID NO: 8205 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDASAEPPSMTQLLRR

SEQ ID NO: 8206 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDAAGEPPSMTQLLRR

SEQ ID NO: 8207 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDAASEPPSMTQLLRR

SEQ ID NO: 8208 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKAGVSNKDIEKETAKDAAAEPPSMTQLLRR

SEQ ID NO: 8209 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDGGGEPPSMTQLLRR

SEQ ID NO: 8210 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDGGSEPPSMTQLLRR

SEQ ID NO: 8211 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDGGAEPPSMTQLLRR

SEQ ID NO: 8212 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDGSGEPPSMTQLLRR

SEQ ID NO: 8213 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDGSSEPPSMTQLLRR

SEQ ID NO: 8214 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDGSAEPPSMTQLLRR

SEQ ID NO: 8215 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDGAGEPPSMTQLLRR

SEQ ID NO: 8216 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDGASEPPSMTQLLRR

SEQ ID NO: 8217 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDGAAEPPSMTQLLRR

SEQ ID NO: 8218 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDSGGEPPSMTQLLRR

SEQ ID NO: 8219 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDSGSEPPSMTQLLRR

SEQ ID NO: 8220 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDSGAEPPSMTQLLRR

SEQ ID NO: 8221 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDSSGEPPSMTQLLRR

SEQ ID NO: 8222 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDSSSEPPSMTQLLRR

SEQ ID NO: 8223 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDSSAEPPSMTQLLRR

SEQ ID NO: 8224 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDSAGEPPSMTQLLRR

SEQ ID NO: 8225 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDSASEPPSMTQLLRR

SEQ ID NO: 8226 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDSAAEPPSMTQLLRR

SEQ ID NO: 8227 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDAGGEPPSMTQLLRR

SEQ ID NO: 8228 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDAGSEPPSMTQLLRR

SEQ ID NO: 8229 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDAGAEPPSMTQLLRR

SEQ ID NO: 8230 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDASGEPPSMTQLLRR

SEQ ID NO: 8231 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDASSEPPSMTQLLRR

SEQ ID NO: 8232 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDASAEPPSMTQLLRR

SEQ ID NO: 8233 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDAAGEPPSMTQLLRR

SEQ ID NO: 8234 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDAASEPPSMTQLLRR

SEQ ID NO: 8235 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKGGVSNKDIEKETAKDAAAEPPSMTQLLRR

SEQ ID NO: 8236 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDGGGEPPSMTQLLRR

SEQ ID NO: 8237 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDGGSEPPSMTQLLRR

SEQ ID NO: 8238 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDGGAEPPSMTQLLRR

SEQ ID NO: 8239 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDGSGEPPSMTQLLRR

SEQ ID NO: 8240 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDGSSEPPSMTQLLRR

SEQ ID NO: 8241 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDGSAEPPSMTQLLRR

SEQ ID NO: 8242 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDGAGEPPSMTQLLRR

SEQ ID NO: 8243 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDGASEPPSMTQLLRR

SEQ ID NO: 8244 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDGAAEPPSMTQLLRR

SEQ ID NO: 8245 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDSGGEPPSMTQLLRR

SEQ ID NO: 8246 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDSGSEPPSMTQLLRR

SEQ ID NO: 8247 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDSGAEPPSMTQLLRR

SEQ ID NO: 8248 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDSSGEPPSMTQLLRR

SEQ ID NO: 8249 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDSSSEPPSMTQLLRR

SEQ ID NO: 8250 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDSSAEPPSMTQLLRR

SEQ ID NO: 8251 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDSAGEPPSMTQLLRR

SEQ ID NO: 8252 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDSASEPPSMTQLLRR

SEQ ID NO: 8253 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDSAAEPPSMTQLLRR

SEQ ID NO: 8254 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDAGGEPPSMTQLLRR

SEQ ID NO: 8255 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDAGSEPPSMTQLLRR

SEQ ID NO: 8256 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDAGAEPPSMTQLLRR

SEQ ID NO: 8257 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDASGEPPSMTQLLRR

SEQ ID NO: 8258 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDASSEPPSMTQLLRR

SEQ ID NO: 8259 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDASAEPPSMTQLLRR

SEQ ID NO: 8260 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDAAGEPPSMTQLLRR

SEQ ID NO: 8261 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDAASEPPSMTQLLRR

SEQ ID NO: 8262 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKDGVSNKDIEKETAKDAAAEPPSMTQLLRR

SEQ ID NO: 8263 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDGGGEPPSMTQLLRR

SEQ ID NO: 8264 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDGGSEPPSMTQLLRR

SEQ ID NO: 8265 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDGGAEPPSMTQLLRR

SEQ ID NO: 8266 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDGSGEPPSMTQLLRR

SEQ ID NO: 8267 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDGSSEPPSMTQLLRR

SEQ ID NO: 8268 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDGSAEPPSMTQLLRR

SEQ ID NO: 8269 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDGAGEPPSMTQLLRR

SEQ ID NO: 8270 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDGASEPPSMTQLLRR

SEQ ID NO: 8271 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDGAAEPPSMTQLLRR

SEQ ID NO: 8272 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDSGGEPPSMTQLLRR

SEQ ID NO: 8273 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDSGSEPPSMTQLLRR

SEQ ID NO: 8274 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDSGAEPPSMTQLLRR

SEQ ID NO: 8275 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDSSGEPPSMTQLLRR

SEQ ID NO: 8276 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDSSSEPPSMTQLLRR

SEQ ID NO: 8277 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDSSAEPPSMTQLLRR

SEQ ID NO: 8278 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDSAGEPPSMTQLLRR

SEQ ID NO: 8279 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDSASEPPSMTQLLRR

SEQ ID NO: 8280 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDSAAEPPSMTQLLRR

SEQ ID NO: 8281 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDAGGEPPSMTQLLRR

SEQ ID NO: 8282 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDAGSEPPSMTQLLRR

SEQ ID NO: 8283 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDAGAEPPSMTQLLRR

SEQ ID NO: 8284 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDASGEPPSMTQLLRR

SEQ ID NO: 8285 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDASSEPPSMTQLLRR

SEQ ID NO: 8286 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDASAEPPSMTQLLRR

SEQ ID NO: 8287 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDAAGEPPSMTQLLRR

SEQ ID NO: 8288 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDAASEPPSMTQLLRR

SEQ ID NO: 8289 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKHGVSNKDIEKETAKDAAAEPPSMTQLLRR

SEQ ID NO: 8290 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDGGGEPPSMTQLLRR

SEQ ID NO: 8291 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDGGSEPPSMTQLLRR

SEQ ID NO: 8292 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDGGAEPPSMTQLLRR

SEQ ID NO: 8293 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDGSGEPPSMTQLLRR

SEQ ID NO: 8294 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDGSSEPPSMTQLLRR

SEQ ID NO: 8295 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDGSAEPPSMTQLLRR

SEQ ID NO: 8296 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDGAGEPPSMTQLLRR

SEQ ID NO: 8297 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDGASEPPSMTQLLRR

SEQ ID NO: 8298 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDGAAEPPSMTQLLRR

SEQ ID NO: 8299 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDSGGEPPSMTQLLRR

SEQ ID NO: 8300 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDSGSEPPSMTQLLRR

SEQ ID NO: 8301 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDSGAEPPSMTQLLRR

SEQ ID NO: 8302 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDSSGEPPSMTQLLRR

SEQ ID NO: 8303 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDSSSEPPSMTQLLRR

SEQ ID NO: 8304 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDSSAEPPSMTQLLRR

SEQ ID NO: 8305 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDSAGEPPSMTQLLRR

SEQ ID NO: 8306 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDSASEPPSMTQLLRR

SEQ ID NO: 8307 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDSAAEPPSMTQLLRR

SEQ ID NO: 8308 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDAGGEPPSMTQLLRR

SEQ ID NO: 8309 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDAGSEPPSMTQLLRR

SEQ ID NO: 8310 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDAGAEPPSMTQLLRR

SEQ ID NO: 8311 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDASGEPPSMTQLLRR

SEQ ID NO: 8312 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDASSEPPSMTQLLRR

SEQ ID NO: 8313 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDASAEPPSMTQLLRR

SEQ ID NO: 8314 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDAAGEPPSMTQLLRR

SEQ ID NO: 8315 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDAASEPPSMTQLLRR

SEQ ID NO: 8316 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKYGVSNKDIEKETAKDAAAEPPSMTQLLRR

SEQ ID NO: 8317 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDGGGEPPSMTQLLRR

SEQ ID NO: 8318 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDGGSEPPSMTQLLRR

SEQ ID NO: 8319 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDGGAEPPSMTQLLRR

SEQ ID NO: 8320 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDGSGEPPSMTQLLRR

SEQ ID NO: 8321 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDGSSEPPSMTQLLRR

SEQ ID NO: 8322 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDGSAEPPSMTQLLRR

SEQ ID NO: 8323 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDGAGEPPSMTQLLRR

SEQ ID NO: 8324 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDGASEPPSMTQLLRR

SEQ ID NO: 8325 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDGAAEPPSMTQLLRR

SEQ ID NO: 8326 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDSGGEPPSMTQLLRR

SEQ ID NO: 8327 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDSGSEPPSMTQLLRR

SEQ ID NO: 8328 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDSGAEPPSMTQLLRR

SEQ ID NO: 8329 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDSSGEPPSMTQLLRR

SEQ ID NO: 8330 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDSSSEPPSMTQLLRR

SEQ ID NO: 8331 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDSSAEPPSMTQLLRR

SEQ ID NO: 8332 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDSAGEPPSMTQLLRR

SEQ ID NO: 8333 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDSASEPPSMTQLLRR

SEQ ID NO: 8334 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDSAAEPPSMTQLLRR

SEQ ID NO: 8335 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDAGGEPPSMTQLLRR

SEQ ID NO: 8336 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDAGSEPPSMTQLLRR

SEQ ID NO: 8337 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDAGAEPPSMTQLLRR

SEQ ID NO: 8338 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDASGEPPSMTQLLRR

SEQ ID NO: 8339 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDASSEPPSMTQLLRR

SEQ ID NO: 8340 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDASAEPPSMTQLLRR

SEQ ID NO: 8341 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDAAGEPPSMTQLLRR

SEQ ID NO: 8342 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDAASEPPSMTQLLRR

SEQ ID NO: 8343 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKKGVSNKDIEKETAKDAAAEPPSMTQLLRR

SEQ ID NO: 8344 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDGGGEPPSMTQLLRR

SEQ ID NO: 8345 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDGGSEPPSMTQLLRR

SEQ ID NO: 8346 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDGGAEPPSMTQLLRR

SEQ ID NO: 8347 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDGSGEPPSMTQLLRR

SEQ ID NO: 8348 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDGSSEPPSMTQLLRR

SEQ ID NO: 8349 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDGSAEPPSMTQLLRR

SEQ ID NO: 8350 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDGAGEPPSMTQLLRR

SEQ ID NO: 8351 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDGASEPPSMTQLLRR

SEQ ID NO: 8352 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDGAAEPPSMTQLLRR

SEQ ID NO: 8353 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDSGGEPPSMTQLLRR

SEQ ID NO: 8354 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDSGSEPPSMTQLLRR

SEQ ID NO: 8355 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDSGAEPPSMTQLLRR

SEQ ID NO: 8356 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDSSGEPPSMTQLLRR

SEQ ID NO: 8357 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDSSSEPPSMTQLLRR

SEQ ID NO: 8358 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDSSAEPPSMTQLLRR

SEQ ID NO: 8359 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDSAGEPPSMTQLLRR

SEQ ID NO: 8360 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDSASEPPSMTQLLRR

SEQ ID NO: 8361 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDSAAEPPSMTQLLRR

SEQ ID NO: 8362 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDAGGEPPSMTQLLRR

SEQ ID NO: 8363 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDAGSEPPSMTQLLRR

SEQ ID NO: 8364 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDAGAEPPSMTQLLRR

SEQ ID NO: 8365 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDASGEPPSMTQLLRR

SEQ ID NO: 8366 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDASSEPPSMTQLLRR

SEQ ID NO: 8367 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDASAEPPSMTQLLRR

SEQ ID NO: 8368 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDAAGEPPSMTQLLRR

SEQ ID NO: 8369 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDAASEPPSMTQLLRR

SEQ ID NO: 8370 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKNGVSNKDIEKETAKDAAAEPPSMTQLLRR

SEQ ID NO: 8371 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDGGGEPPSMTQLLRR

SEQ ID NO: 8372 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDGGSEPPSMTQLLRR

SEQ ID NO: 8373 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDGGAEPPSMTQLLRR

SEQ ID NO: 8374 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDGSGEPPSMTQLLRR

SEQ ID NO: 8375 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDGSSEPPSMTQLLRR

SEQ ID NO: 8376 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDGSAEPPSMTQLLRR

SEQ ID NO: 8377 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDGAGEPPSMTQLLRR

SEQ ID NO: 8378 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDGASEPPSMTQLLRR

SEQ ID NO: 8379 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDGAAEPPSMTQLLRR

SEQ ID NO: 8380 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDSGGEPPSMTQLLRR

SEQ ID NO: 8381 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDSGSEPPSMTQLLRR

SEQ ID NO: 8382 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDSGAEPPSMTQLLRR

SEQ ID NO: 8383 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDSSGEPPSMTQLLRR

SEQ ID NO: 8384 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDSSSEPPSMTQLLRR

SEQ ID NO: 8385 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDSSAEPPSMTQLLRR

SEQ ID NO: 8386 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDSAGEPPSMTQLLRR

SEQ ID NO: 8387 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDSASEPPSMTQLLRR

SEQ ID NO: 8388 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDSAAEPPSMTQLLRR

SEQ ID NO: 8389 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDAGGEPPSMTQLLRR

SEQ ID NO: 8390 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDAGSEPPSMTQLLRR

SEQ ID NO: 8391 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDAGAEPPSMTQLLRR

SEQ ID NO: 8392 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDASGEPPSMTQLLRR

SEQ ID NO: 8393 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDASSEPPSMTQLLRR

SEQ ID NO: 8394 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDASAEPPSMTQLLRR

SEQ ID NO: 8395 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDAAGEPPSMTQLLRR

SEQ ID NO: 8396 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDAASEPPSMTQLLRR

SEQ ID NO: 8397 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDCFGLRGLLHLENASYGIEPLQNSSHFEHIIYRMDDVYKEPLKMGVSNKDIEKETAKDAAAEPPSMTQLLRR

SEQ ID NO: 8398 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDGGGEPPSMTQLLRR

SEQ ID NO: 8399 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDGGSEPPSMTQLLRR

SEQ ID NO: 8400 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDGGAEPPSMTQLLRR

SEQ ID NO: 8401 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDGSGEPPSMTQLLRR

SEQ ID NO: 8402 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDGSSEPPSMTQLLRR

SEQ ID NO: 8403 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDGSAEPPSMTQLLRR

SEQ ID NO: 8404 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDGAGEPPSMTQLLRR

SEQ ID NO: 8405 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDGASEPPSMTQLLRR

SEQ ID NO: 8406 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDGAAEPPSMTQLLRR

SEQ ID NO: 8407 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDSGGEPPSMTQLLRR

SEQ ID NO: 8408 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDSGSEPPSMTQLLRR

SEQ ID NO: 8409 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDSGAEPPSMTQLLRR

SEQ ID NO: 8410 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDSSGEPPSMTQLLRR

SEQ ID NO: 8411 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDSSSEPPSMTQLLRR

SEQ ID NO: 8412 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDSSAEPPSMTQLLRR

SEQ ID NO: 8413 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDSAGEPPSMTQLLRR

SEQ ID NO: 8414 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDSASEPPSMTQLLRR

SEQ ID NO: 8415 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDSAAEPPSMTQLLRR

SEQ ID NO: 8416 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDAGGEPPSMTQLLRR

SEQ ID NO: 8417 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDAGSEPPSMTQLLRR

SEQ ID NO: 8418 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDAGAEPPSMTQLLRR

SEQ ID NO: 8419 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDASGEPPSMTQLLRR

SEQ ID NO: 8420 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDASSEPPSMTQLLRR

SEQ ID NO: 8421 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDASAEPPSMTQLLRR

SEQ ID NO: 8422 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDAAGEPPSMTQLLRR

SEQ ID NO: 8423 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDAASEPPSMTQLLRR

SEQ ID NO: 8424 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKCGVSNKDIEKETAKDAAAEPPSMTQLLRR

SEQ ID NO: 8425 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDGGGEPPSMTQLLRR

SEQ ID NO: 8426 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDGGSEPPSMTQLLRR

SEQ ID NO: 8427 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDGGAEPPSMTQLLRR

SEQ ID NO: 8428 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDGSGEPPSMTQLLRR

SEQ ID NO: 8429 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDGSSEPPSMTQLLRR

SEQ ID NO: 8430 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDGSAEPPSMTQLLRR

SEQ ID NO: 8431 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDGAGEPPSMTQLLRR

SEQ ID NO: 8432 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDGASEPPSMTQLLRR

SEQ ID NO: 8433 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDGAAEPPSMTQLLRR

SEQ ID NO: 8434 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDSGGEPPSMTQLLRR

SEQ ID NO: 8435 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDSGSEPPSMTQLLRR

SEQ ID NO: 8436 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDSGAEPPSMTQLLRR

SEQ ID NO: 8437 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDSSGEPPSMTQLLRR

SEQ ID NO: 8438 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDSSSEPPSMTQLLRR

SEQ ID NO: 8439 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDSSAEPPSMTQLLRR

SEQ ID NO: 8440 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDSAGEPPSMTQLLRR

SEQ ID NO: 8441 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDSASEPPSMTQLLRR

SEQ ID NO: 8442 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDSAAEPPSMTQLLRR

SEQ ID NO: 8443 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDAGGEPPSMTQLLRR

SEQ ID NO: 8444 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDAGSEPPSMTQLLRR

SEQ ID NO: 8445 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDAGAEPPSMTQLLRR

SEQ ID NO: 8446 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDASGEPPSMTQLLRR

SEQ ID NO: 8447 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDASSEPPSMTQLLRR

SEQ ID NO: 8448 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDASAEPPSMTQLLRR

SEQ ID NO: 8449 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDAAGEPPSMTQLLRR

SEQ ID NO: 8450 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDAASEPPSMTQLLRR

SEQ ID NO: 8451 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKSGVSNKDIEKETAKDAAAEPPSMTQLLRR

SEQ ID NO: 8452 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDGGGEPPSMTQLLRR

SEQ ID NO: 8453 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDGGSEPPSMTQLLRR

SEQ ID NO: 8454 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDGGAEPPSMTQLLRR

SEQ ID NO: 8455 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDGSGEPPSMTQLLRR

SEQ ID NO: 8456 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDGSSEPPSMTQLLRR

SEQ ID NO: 8457 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDGSAEPPSMTQLLRR

SEQ ID NO: 8458 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDGAGEPPSMTQLLRR

SEQ ID NO: 8459 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDGASEPPSMTQLLRR

SEQ ID NO: 8460 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDGAAEPPSMTQLLRR

SEQ ID NO: 8461 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDSGGEPPSMTQLLRR

SEQ ID NO: 8462 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDSGSEPPSMTQLLRR

SEQ ID NO: 8463 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDSGAEPPSMTQLLRR

SEQ ID NO: 8464 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDSSGEPPSMTQLLRR

SEQ ID NO: 8465 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDSSSEPPSMTQLLRR

SEQ ID NO: 8466 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDSSAEPPSMTQLLRR

SEQ ID NO: 8467 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDSAGEPPSMTQLLRR

SEQ ID NO: 8468 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDSASEPPSMTQLLRR

SEQ ID NO: 8469 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDSAAEPPSMTQLLRR

SEQ ID NO: 8470 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDAGGEPPSMTQLLRR

SEQ ID NO: 8471 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDAGSEPPSMTQLLRR

SEQ ID NO: 8472 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDAGAEPPSMTQLLRR

SEQ ID NO: 8473 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDASGEPPSMTQLLRR

SEQ ID NO: 8474 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDASSEPPSMTQLLRR

SEQ ID NO: 8475 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDASAEPPSMTQLLRR

SEQ ID NO: 8476 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDAAGEPPSMTQLLRR

SEQ ID NO: 8477 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDAASEPPSMTQLLRR

SEQ ID NO: 8478 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKAGVSNKDIEKETAKDAAAEPPSMTQLLRR

SEQ ID NO: 8479 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDGGGEPPSMTQLLRR

SEQ ID NO: 8480 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDGGSEPPSMTQLLRR

SEQ ID NO: 8481 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDGGAEPPSMTQLLRR

SEQ ID NO: 8482 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDGSGEPPSMTQLLRR

SEQ ID NO: 8483 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDGSSEPPSMTQLLRR

SEQ ID NO: 8484 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDGSAEPPSMTQLLRR

SEQ ID NO: 8485 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDGAGEPPSMTQLLRR

SEQ ID NO: 8486 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDGASEPPSMTQLLRR

SEQ ID NO: 8487 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDGAAEPPSMTQLLRR

SEQ ID NO: 8488 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDSGGEPPSMTQLLRR

SEQ ID NO: 8489 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDSGSEPPSMTQLLRR

SEQ ID NO: 8490 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDSGAEPPSMTQLLRR

SEQ ID NO: 8491 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDSSGEPPSMTQLLRR

SEQ ID NO: 8492 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDSSSEPPSMTQLLRR

SEQ ID NO: 8493 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDSSAEPPSMTQLLRR

SEQ ID NO: 8494 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDSAGEPPSMTQLLRR

SEQ ID NO: 8495 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDSASEPPSMTQLLRR

SEQ ID NO: 8496 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDSAAEPPSMTQLLRR

SEQ ID NO: 8497 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDAGGEPPSMTQLLRR

SEQ ID NO: 8498 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDAGSEPPSMTQLLRR

SEQ ID NO: 8499 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDAGAEPPSMTQLLRR

SEQ ID NO: 8500 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDASGEPPSMTQLLRR

SEQ ID NO: 8501 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDASSEPPSMTQLLRR

SEQ ID NO: 8502 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDASAEPPSMTQLLRR

SEQ ID NO: 8503 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDAAGEPPSMTQLLRR

SEQ ID NO: 8504 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDAASEPPSMTQLLRR

SEQ ID NO: 8505 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKGGVSNKDIEKETAKDAAAEPPSMTQLLRR

SEQ ID NO: 8506 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDGGGEPPSMTQLLRR

SEQ ID NO: 8507 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDGGSEPPSMTQLLRR

SEQ ID NO: 8508 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDGGAEPPSMTQLLRR

SEQ ID NO: 8509 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDGSGEPPSMTQLLRR

SEQ ID NO: 8510 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDGSSEPPSMTQLLRR

SEQ ID NO: 8511 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDGSAEPPSMTQLLRR

SEQ ID NO: 8512 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDGAGEPPSMTQLLRR

SEQ ID NO: 8513 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDGASEPPSMTQLLRR

SEQ ID NO: 8514 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDGAAEPPSMTQLLRR

SEQ ID NO: 8515 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDSGGEPPSMTQLLRR

SEQ ID NO: 8516 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDSGSEPPSMTQLLRR

SEQ ID NO: 8517 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDSGAEPPSMTQLLRR

SEQ ID NO: 8518 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDSSGEPPSMTQLLRR

SEQ ID NO: 8519 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDSSSEPPSMTQLLRR

SEQ ID NO: 8520 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDSSAEPPSMTQLLRR

SEQ ID NO: 8521 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDSAGEPPSMTQLLRR

SEQ ID NO: 8522 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDSASEPPSMTQLLRR

SEQ ID NO: 8523 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDSAAEPPSMTQLLRR

SEQ ID NO: 8524 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDAGGEPPSMTQLLRR

SEQ ID NO: 8525 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDAGSEPPSMTQLLRR

SEQ ID NO: 8526 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDAGAEPPSMTQLLRR

SEQ ID NO: 8527 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDASGEPPSMTQLLRR

SEQ ID NO: 8528 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDASSEPPSMTQLLRR

SEQ ID NO: 8529 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDASAEPPSMTQLLRR

SEQ ID NO: 8530 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDAAGEPPSMTQLLRR

SEQ ID NO: 8531 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDAASEPPSMTQLLRR

SEQ ID NO: 8532 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKDGVSNKDIEKETAKDAAAEPPSMTQLLRR

SEQ ID NO: 8533 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDGGGEPPSMTQLLRR

SEQ ID NO: 8534 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDGGSEPPSMTQLLRR

SEQ ID NO: 8535 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDGGAEPPSMTQLLRR

SEQ ID NO: 8536 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDGSGEPPSMTQLLRR

SEQ ID NO: 8537 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDGSSEPPSMTQLLRR

SEQ ID NO: 8538 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDGSAEPPSMTQLLRR

SEQ ID NO: 8539 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDGAGEPPSMTQLLRR

SEQ ID NO: 8540 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDGASEPPSMTQLLRR

SEQ ID NO: 8541 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDGAAEPPSMTQLLRR

SEQ ID NO: 8542 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDSGGEPPSMTQLLRR

SEQ ID NO: 8543 - protein, 174 aa, Artificial Sequence
  Artificial ADAM9 prodomain peptide
ARPGFQQTSHLSSYEIITPWRLTRERREAPRPYSKQVSYVIQAEGKEHIIHLERNKDLLPEDFVVYTYNKEGTLITDHPNIQNHGHYRGYVEGVHNSSIALSDSFGLRGLLHLENASYGIEPLQNSSHFEHIIYRMDDVYKEPLKHGVSNKDIEKETAKDSGSEPPSMTQLLRR

(The sequence listing continues in the following parts.)

What is claimed is:

1. A peptide comprising SEQ ID NO: 3, wherein relative to the amino acid sequence set forth in SEQ ID NO: 2, the peptide includes one or more amino acid substitutions and/or chemical modifications at amino acid position(s) 85, 104, and 146, wherein the substitution(s) are selected from substitution of the cysteine with serine, alanine, or glycine.

2. The peptide of claim 1, wherein relative to the amino acid sequence set forth in SEQ ID NO:2, the peptide further includes one or more amino acid substitutions and/or modifications at amino acid position(s) 6, 7, 24, 26, 27, 61, 62, 137, 138, 160, 161, 162, 163, and/or 164 such that the peptide is less inhibitory towards meprin, is less sensitive to furin cleavage, or a combination thereof, as compared to a peptide without the one or more amino acid substitutions and/or modifications.

3. The peptide of claim 1, wherein, as compared to SEQ ID NO: 2, the amino acid sequence comprises:
   a chemical modification of one, two, or all three of cysteines 85, 104, and 146,
   a substitution of cysteine 85 to serine, alanine, or glycine and a chemical modification of one or two of cysteines 104 and 146;
   a substitution of cysteine 104 to serine, alanine, or glycine and a chemical modification of one or two of cysteines 85 and 146;
   a substitution of cysteine 146 to serine, alanine, or glycine and a chemical modification of one or two of cysteines 85 and 104; or
   a substitution of any two of cysteines 85, 104, and 146 to serine, alanine, or glycine with a chemical modification of the cysteine which is not substituted at positions 85, 104, or 146.

4. The peptide of claim 3, wherein relative to the amino acid sequence set forth in SEQ ID NO:2, the peptide further comprises (vi) a substitution of arginine 24 to another amino acid; (vii) a substitution of arginine 26 to another amino acid; (viii) a substitution of arginine 27 to another amino acid; or (ix) any combination of (vi)-(viii).

5. The peptide of claim 4, wherein
   (vi) the arginine at position 24 is substituted with alanine, serine, glycine, or lysine;
   (vii) the arginine at position 26 is substituted with alanine, serine, glycine, or lysine;
   (viii) the arginine at position 27 is substituted with alanine, serine, glycine, or lysine;
   or any combination thereof.

6. The peptide of claim 1 wherein, as compared to SEQ ID NO: 2, the peptide comprises
   (i) a substitution at each of amino acids 85, 104, and 146, wherein the substitution(s) are selected from substitution of the cysteine with serine, alanine, or glycine; or
   (ii) a substitution at amino acid 85, wherein the substitution is selected from substitution of the cysteine with serine, alanine, or glycine, and a chemical modification at amino acid 104 or amino acid 146 or both amino acids 104 and 146; or
   (iii) a substitution at amino acid 104, wherein the substitution is selected from substitution of the cysteine with serine, alanine, or glycine, and a chemical modification at amino acid 85 or amino acid 146 or both amino acids 85 and 146; or
   (iv) a substitution at amino acid 146, wherein the substitution is selected from substitution of the cysteine with serine, alanine, or glycine, and a chemical modification at amino acid 85 or amino acid 104 or both amino acids 85 and 104.

7. The peptide of claim 6, wherein relative to the amino acid sequence set forth in SEQ ID NO:2, the amino acid sequence comprises (xvii) a substitution at amino acid 24 and a substitution at amino acid 26; or (xviii) a substitution at amino acid 24 and a substitution at amino acid 27; or (ix) a substitution at amino acid 26 and a substitution at amino acid 27; or (xx) a substitution at amino acid 24; a substitution at amino acid 26 and a substitution at amino acid 27; or (xxi) a substitution at one, two, or all three of amino acids 161, 163, and 164; or (xxii) a substitution at one, two, or all three of amino acids 162-164; or (xxiii) a substitution at one or both of amino acids 61 and 62; or (xxiv) a substitution at one or both of amino acids 137 and 138; or (xxv) any combination of (xvii)-(xxiv).

8. The peptide of claim 7, wherein the amino acid sequence comprises (xvii) the amino acid at position 24 and the amino acid at position 26 are independently selected from alanine, serine, glycine, or lysine; or (xviii) the amino acid at position 24 and the amino acid at position 27 are independently selected from alanine, serine, glycine, or lysine; or (ix) the amino acid at position 26 and the amino acid at position 27 are independently selected from alanine, serine, glycine, or lysine; or (xx) the amino acid at position 24, the amino acid at position 26, and the amino acid at position 27 are independently selected from alanine, serine, glycine, or lysine; or (xxi) the amino acid at one, two, or all three of positions 161, 163, and 164 asparagine, glycine, alanine, or serine; or (xxii) the amino acid at position at one, two, or all three of positions 162-164 is asparagine, glycine, alanine, or serine; or (xxiii) the amino acid at positions 61 and 62 is asparagine, alanine, serine, or glycine; or (xxiv) the amino acid at position at one or both of positions 137 and 138 is asparagine, alanine, serine, or glycine; or (xxv) any combination of (xvii)-(xxiv).

9. The peptide of claim 1, wherein, as compared to SEQ ID NO:2, the peptide comprises: (i) an alanine at amino acid 26 and serines at amino acids 85, 104, and 146; or (ii) an alanine at amino acid 24 and serines at amino acids 85, 104, and 146; or (iii) an alanine at amino acid 27 and serines at amino acids 85, 104, and 146; or (iv) serines at amino acids 85, 104, and 146; or (v) an alanine at amino acid 26, serines at amino acids 85, 104, and 146, and an alanine at amino acid 62; or (vi) a glycine at amino acid 27 and serines at amino acids 85, 104, and 146; or (vii) a serine at amino acid 27 and serines at amino acids 85, 104, and 146; or (viii) an alanine at amino acid 27; serines at amino acids 85, 104, and 146; and a serine at amino acid 138; or (ix) an alanine at amino acid 27, serines at amino acids 85, 104, and 146, and asparagines at amino acids 161 and 163; or (x) an alanine at amino acid 26, serines at amino acids 85, 104, and 146, and an addition of a GSGSC (SEQ ID NO: 27) pentapeptide C-terminal to amino acid 174 of SEQ ID NO: 3; or (xi) an alanine, glycine, or serine at amino acid 27, serines at amino acids 85, 104, and 146, and an addition of a GSCGS (SEQ ID NO: 26) pentapeptide N-terminal to amino acid 1 of SEQ ID NO: 3; or (xii) an alanine, glycine, or serine at amino acid 27, serines at amino acids 85, 104, and 146, and an addition of a GSGSC (SEQ ID NO: 27) pentapeptide C-terminal to amino acid 174 of SEQ ID NO: 3.

10. The peptide of claim 1, wherein the sequence comprises a cysteine at one, two, or all three of amino acid positions 85, 104, and 146, and one, two, or all three cysteine(s) is/are chemically modified at a sulfhydryl group.

11. The peptide of claim 10, wherein the sulfhydryl group(s) is/are chemically modified by addition of a maleimide ester, an α-halocarbonyl, a thiosulfonate, or any combination thereof.

12. The peptide of claim 1, wherein (a) the amino acid at position 146 is pegylated cysteine and/or (b) the peptide further comprises a pegylated cysteine added to the N-terminus, to the C-terminus, or both, and/or (c) the peptide further comprises SEQ ID NO: 26 and/or SEQ ID NO: 27 having a pegylated cysteine.

13. The peptide of claim 1, wherein one or more of cysteines at positions 85, 104, and/or 146 comprises a chemical modification with a maleimide ester.

14. The peptide of claim 1, wherein one or more of cysteines at positions 85, 104, and/or 146 comprises a chemical modification resulting from reacting the one or more cysteines with a disulfide.

15. A pharmaceutical composition comprising the peptide of claim 1.

16. The peptide of claim 1, wherein the peptide is conjugated to a therapeutic moiety, a diagnostic moiety, a detectable moiety, or any combination thereof.

17. The peptide of claim 16, wherein the moiety is a chemotherapeutic agent.

18. A peptide comprising an amino acid sequence having at least 87% sequence identity to the full-length sequence of SEQ ID NO: 13, wherein relative to the amino acid sequence set forth in SEQ ID NO: 2, the peptide includes an amino acid substitution and/or modification at amino acid position(s) 85, 104, and 146.

19. A peptide comprising an amino acid sequence having at least 95% sequence identity to the full-length sequence of SEQ ID NO: 13, wherein relative to the amino acid sequence set forth in SEQ ID NO: 2, the peptide includes an amino acid substitution and/or modification at amino acid position(s) 85, 104, and 146.

20. A peptide comprising 100% sequence identity to SEQ ID NO: 13 over its full length.

21. A peptide fragment comprising amino acids 7-174 of SEQ ID NO: 3, wherein as compared to SEQ ID NO: 2, the amino acid sequence of the fragment comprises an alanine at amino acid 27; serines at amino acids 85, 104, and 146; and the fragment does not comprise amino acids 1-6 of SEQ ID NO: 3.

* * * * *